US010351867B2

(12) United States Patent
Jacobsen et al.

(10) Patent No.: US 10,351,867 B2
(45) Date of Patent: Jul. 16, 2019

(54) METHODS AND COMPOSITIONS FOR TARGETING RNA POLYMERASES AND NON-CODING RNA BIOGENESIS TO SPECIFIC LOCI

(71) Applicant: The Regents of the University of California, Oakland, CA (US)

(72) Inventors: Steve E. Jacobsen, Agoura Hills, CA (US); Javier Gallego-Bartolomé, Beverly Hills, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

(21) Appl. No.: 14/772,066

(22) PCT Filed: Feb. 28, 2014

(86) PCT No.: PCT/US2014/019666
§ 371 (c)(1),
(2) Date: Sep. 1, 2015

(87) PCT Pub. No.: WO2014/134567
PCT Pub. Date: Sep. 4, 2014

(65) Prior Publication Data
US 2016/0017348 A1 Jan. 21, 2016

Related U.S. Application Data

(60) Provisional application No. 61/929,414, filed on Jan. 20, 2014, provisional application No. 61/771,743, filed on Mar. 1, 2013.

(51) Int. Cl.
C12N 15/82 (2006.01)
C07K 14/415 (2006.01)
(52) U.S. Cl.
CPC ........ C12N 15/8218 (2013.01); C07K 14/415 (2013.01); C12N 15/8216 (2013.01)
(58) Field of Classification Search
None
See application file for complete search history.

(56) References Cited

U.S. PATENT DOCUMENTS

| | | |
|---|---|---|
| 4,945,050 A | 7/1990 | Sanford et al. |
| 5,268,463 A | 12/1993 | Jefferson |
| 5,399,680 A | 3/1995 | Zhu et al. |
| 5,466,785 A | 11/1995 | De Framond |
| 5,563,055 A | 10/1996 | Townsend et al. |
| 5,569,597 A | 10/1996 | Grimsley et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,641,876 A | 6/1997 | McElroy et al. |
| 5,683,439 A | 11/1997 | Jensen |
| 5,689,049 A | 11/1997 | Cigan et al. |
| 5,689,051 A | 11/1997 | Cigan et al. |
| 5,967,213 A | 10/1999 | Smiley et al. |
| 2011/0167521 A1* | 7/2011 | DeKelver .......... C12N 15/8216 800/298 |
| 2014/0018241 A1 | 1/2014 | Sammons et al. |

FOREIGN PATENT DOCUMENTS

| | | |
|---|---|---|
| KR | 10-2010-0130430 A | 12/2010 |
| WO | 2000/047754 A1 | 8/2000 |
| WO | 2003/010308 A2 | 2/2003 |

OTHER PUBLICATIONS

Kanno et al 2008 Nat Genet 40:670-6675.*
Li et al 2011 Nucleic Acids Res. 39:6315-25.*
Lorkovic et al 2012 Current Biology 22:933-938.*
International Preliminary Report on Patentability received for PCT Patent Application No. PCT/US2014/019666, dated Sep. 11, 2015, 17 pages.
International Search Report and Written Opinion received for PCT Patent Application No. PCT/US2014/019666, dated Jun. 26, 2014, 23 pages.
Kuhlmann et al., "Developmentally Non-Redundant SET Domain Proteins SUVH2 and SUVH9 are Required for Transcriptional Gene Silencing in *Arabidopsis thaliana*", Plant Molecular Biology, vol. 79, 2012, pp. 623-633.
Law et al., "SHH1, A Homeodomain Protein Required for DNA Methylation, as Well as RDR2, RDM4, and Chromatin Remodeling Factors, Associate with RNA Polymerase IV", PLOS Genetics, vol. 7, No. 7, Jul. 21, 2011, pp. 1-10.
Baumbusch et al., "The *Arabidopsis thaliana* genome contains at least 29 active genes encoding SET domain proteins that can be assigned to four evolutionarily conserved classes", GenBank Accession No. AF344452.1, available online at <http://www.ncbi.nlm.nih.gov/nuccore/AF344452.1>, Nov. 6, 2001, 2 pages.
"Abbreviations and Symbols for Nucleic Acids, Polynucleotides, and their Constituents", Biochemistry, vol. 9, No. 20, 1970, pp. 4022-4027.
Adams et al., "PHENIX: A Comprehensive Python-Based System for Macromolecular Structure Solution", Acta Crystallographica Section D Biological Crystallography, vol. D66, 2010, pp. 213-221.
Altschul et al., "Gapped BLAST and PSI-BLAST: A New Generation of Protein Database Search Programs", Nucleic Acids Research, vol. 25, No. 17, 1997, pp. 3389-3402.
Altschul et al., "Basic Local Alignment Search Tool", Journal of Molecular Biology, vol. 215, 1990, pp. 403-410.
Arita et al., "Recognition of Hemi-Methylated DNA by the SRA Protein UHRF1 by a Base-Flipping Mechanism", Nature, vol. 455, Oct. 9, 2008, pp. 818-821.

(Continued)

Primary Examiner — Brent T Page
(74) Attorney, Agent, or Firm — Morrison & Foerster LLP

(57) ABSTRACT

The present disclosure relates to recombinant proteins that induce epigenetic gene silencing and to methods of using such proteins for reducing the expression of genes in plants.

15 Claims, 26 Drawing Sheets
Specification includes a Sequence Listing.

(56) References Cited

OTHER PUBLICATIONS

Aufsatz et al., "RNA-Directed DNA Methylation in *Arabidopsis*", PNAS, vol. 99, No. 4, Dec. 10, 2002, pp. 16499-16506.
Aufsatz et al., "The Role of MET1 in RNA-Directed De Novo and Maintenance Methylation of CG Dinucleotides", Plant Molecular Biology, vol. 54, 2004, pp. 793-804.
Avvakumov et al., "Structural Basis for Recognition of Hemi-Methylated DNA by the SRA Domain of Human UHRF1", Nature, vol. 455, Oct. 9, 2008, pp. 822-825.
Berger et al., "Expression in Transgenic Plants of a Viral Gene Product that Mediates Insect Transmission of Potyviruses", Proc. Natl. Acad. Sci., vol. 86, Nov. 1989, pp. 8402-8406.
Bernatavichute et al., "Genome-Wide Association of Histone H3 Lysine Nine Methylation with CHG DNA Methylation in *Arabidopsis thaliana*", PLoS One, vol. 3, No. 9, Sep. 2008, pp. 1-11.
Bian et al., "Sgf29 Binds Histone H3K4me2/3 and is required for SAGA Complex Recruitment and Histone H3 Acetylation", The EMBO Journal, vol. 30, No. 14, 2011, pp. 2829-2842.
Black et al., "Histone Lysine Methylation Dynamics: Establishment, Regulation, and Biological Impact", Molecular Cell, vol. 48, No. 4, Nov. 30, 2012, pp. 491-507.
Bogdanove et al., "TAL Effectors: Customizable Proteins for DNA Targeting", Science, vol. 333, Sep. 30, 2011, pp. 1843-1846.
Bostick et al., "UHRF1 Plays a Role in Maintaining DNA Methylation in Mammalian Cells", Science, vol. 317, Sep. 21, 2007, pp. 1760-1764.
Brzeski et al., "Deficient in DNA Methylation 1 (DDM1) Defines a Novel Family of Chromatin-Remodelinq Factors", The Journal of Biological Chemistry, vol. 278, No. 2, Jan. 10, 2003, pp. 823-828.
Cao et al., "Role of the *Arabidopsis* DRM Methyltransferases in De Novo DNA Methylation and Gene Silencing", Current Biology, vol. 12, Jul. 9, 2002, pp. 1138-1144.
Cao et al., "Role of the DRM and CMT3 Methyltransferases in RNA-Directed DNA Methylation", Current Biology, vol. 13, Dec. 16, 2003, pp. 2212-2217.
Cedar et al., "Linking DNA Methylation and Histone Modification: Patterns and Paradigms", Nature Reviews Genetics, vol. 10, May 2009, pp. 295-304.
Chan et al., "Two-Step Recruitment of RNA-Directed DNA Methylation to Tandem Repeats", PLoS Biology, vol. 4, No. 11, Nov. 2006, pp. 1923-1933.
Christensen et al., "Maize Polyubiquitin Genes: Structure, Thermal Perturbation of Expression and Transcript Splicing, and Promoter Activity Following Transfer to Protoplasts by Electroporation", Plant Molecular Biology, vol. 18, 1992, pp. 675-689.
Christensen et al., "Sequence Analysis and Transcriptional Regulation by Heat Shock of Polyubiquitin Transcripts from Maize", Plant Molecular Biology, vol. 12, 1989, pp. 619-632.
Clough et al., "Floral Dip: A Simplified Method for Agrobacterium-Mediated Transformation of *Arabidopsis thaliana*", Plant Journal, vol. 16, No. 6, 1998, pp. 735-743.
Cokus et al., "Shotgun Bisulfite Sequencing of the *Arabidopsis* Genome Reveals DNA Methylation Patterning", Nature, vol. 452, No. 7184, Mar. 13, 2013, pp. 215-219.
Du et al., "Dual Binding of Chromomethylase Domains to H3K9me2-Containing Nucleosomes Directs DNA Methylation in Plants", Cell, vol. 151, Sep. 28, 2012, pp. 167-180.
Dunoyer et al., "Small RNA Duplexes Function as Mobile Silencing Signals Between Plants Cells", Science, vol. 328, May 14, 2010, pp. 912-916.
Ebbs et al., "Locus-Specific Control of DNA Methylation by the *Arabidopsis* SUVH5 Histone Methyltransferase", The Plant Cell, vol. 18, May 2006, pp. 1166-1176.
El-Shami et al., "Reiterated WG/GW motifs form Functionally and Evolutionarily Conserved ARGONAUTE-Binding Platforms in RNAi-Related Components", Genes & Development, vol. 21, 2007, pp. 2539-2544.

Emsley et al., "Features and Development of Cool", Acta Crystallographica Section D Biological Crystallography, vol. D66, 2010, pp. 486-501.
Feng et al., "Determining DNA Methylation Profiles Using Sequencing", Chapter 16, Methods in Molecular Biology, vol. 733, 2011, pp. 223-238.
Finnegan et al., "Isolation and Identification by Sequence Homology of a Putative Cytosine Methyltransferase from *Arabidopsis thaliana*", Nucleic Acids Research, vol. 21, No. 10, 1993, pp. 2383-2388.
Fischer et al., "Heterochromatin Proteins and the Control of Heterochromatic Gene Silencing in *Arabidopsis*", Journal of Plant Physiology, vol. 163, 2006, pp. 358-368.
Fusaro et al., "RNA Interference-Inducing Hairpin RNAs in Plants Act through the Viral Defence Pathway", European Molecular Biology Organization Reports, vol. 7, No. 11, 2006, pp. 1168-1175.
Gouet et al., "ESPript: Analysis of Multiple Sequence Alignments in PostScript", Bioinformatics, vol. 15, No. 4, 1999, pp. 305-308.
Haag et al., "Multisubunit RNA Polymerases IV and V: Purveyors of Non-Coding RNA for Plant Gene Silencing", Molecular Cell Biology, vol. 12, Aug. 2011, pp. 483-492.
Hashimoto et al., "The SRA Domain of UHRF1 Flips 5-Methylcytosine Out of the DNA Helix", Nature, vol. 455, No. 7214, Oct. 9, 2008, pp. 826-829.
Henderson et al., "The De Novo Cytosine Methyltransferase DRM2 Requires Intact UBA Domains and a Catalytically Mutated Paralog DRM3 during RNA-Directed DNA Methylation in *Arabidopsis thaliana*", PLoS Genetics, vol. 6, No. 10, Oct. 2010, pp. 1-11.
Henikoff et al., "Amino Acid Substitution Matrices from Protein Blocks", Proceedings of the National Academy of Sciences, vol. 89, Nov. 1992, pp. 10915-10919.
Holm et al., "Dali Server: Conservation Mapping in 3D", Nucleic Acids Research, vol. 38, Web Server Issue, May 10, 2010, pp. W545-W549.
Jackson et al., "Control of CpNpG DNA Methylation by the Kryptonite Histone H3 Methyltransferase", Nature, vol. 416, Apr. 4, 2002, pp. 556-560.
Johnson et al., "SRA- and SET-Domain-Containing Proteins Link RNA Polymerase V Occupancy to DNA Methylation", Nature, vol. 507, Mar. 6, 2014, pp. 124-128.
Johnson et al., "Corrigendum: SRA- and SET-Domain-Containing Proteins link RNA Polymerase V Occupancy to DNA Methylation", Nature, vol. 507, 2014, 1 page.
Johnson et al., "SRA-Domain Proteins Required for DRM2-Mediated De Novo DNA Methylation", PLoS Genetics, vol. 4, No. 11. Nov. 2008, pp. 1-13.
Johnson et al., "The SRA Methyl-Cytosine-Binding Domain Links DNA and Histone Methylation", Current Biology, vol. 17, No. 4, Feb. 20, 2007, pp. 379-384.
Jones, Peter A., "Functions of DNA Methylation: Islands, Start Sites, Gene Bodies and Beyond", Nature Reviews Genetics, vol. 13, Jul. 2012, pp. 484-492.
Joung et al., "TALENs: A Widely Applicable Technology for Targeted Genome Editing", Nature Reviews Molecular Cell Biology, vol. 14, Jan. 2013, pp. 49-55.
Kakutani, Tetsuji, "Genetic Characterization of Late-Flowering Traits Induced by DNA Hypomethylation Mutation in *Arabidopsis thaliana*", The Plant Journal, vol. 12, No. 6, 1997, pp. 1447-1451.
Karlin et al., "Applications and Statistics for Multiple High-Scoring Segments in Molecular Sequences", Proc. Natl. Acad. Sci., vol. 90, Jun. 1993, pp. 5873-5877.
Kinoshita et al., "Control of FWA Gene Silencing in *Arabidopsis thaliana* by SINE-Related Direct Repeats", The Plant Journal, vol. 49, 2006, pp. 38-45.
Kolb et al., "Site-Directed Genome Modification: Nucleic Acid and Protein Modules for Targeted Integration and Gene Correction", Trends in Biotechnology, vol. 23, No. 8, Aug. 2005, pp. 399-406.
Larkin et al., "Clustal W and Clustal X Version 2.0", Bioinformatics, vol. 23, No. 21, 2007, pp. 2947-2948.
Laskowski et al., "PROCHECK: A Program to Check the Stereochemical Quality of Protein Structures", J. Appl. Cryst., vol. 26, 1993, pp. 283-291.

(56) References Cited

OTHER PUBLICATIONS

Last et al., "pEmu: An Improved Promoter for Gene Expression in Cereal Cells", Theoretical and Applied Genetics, vol. 81, 1991, pp. 581-588.

Law et al., "A Protein Complex Required for Polymerase V Transcripts and RNA-Directed DNA Methylation in Plants", Curr Biol., vol. 20, No. 10, May 25, 2010, pp. 951-956.

Law et al., "Establishing, Maintaining and Modifying DNA Methylation Patterns in Plants and Animals", Nat Rev Genet., vol. 11, No. 3, Mar. 2010, pp. 204-220.

Law et al., "Polymerase-IV Occupancy at RNA-Directed DNA Methylation Sites requires SHH1", Nature, vol. 498, No. 7454, Jun. 20, 2013, pp. 385-389.

Li et al., "An ARGONAUTE4-Containing Nuclear Processing Center Colocalized with Cajal Bodies in *Arabidopsis thaliana*", Cell, vol. 126, Jul. 14, 2006, pp. 93-106.

Lindroth et al., "Dual Histone H3 Methylation Marks at Lysines 9 and 27 required for Interaction with CHROMOMETHYLASE3", The EMBO Journal, vol. 23, No. 21, 2004, pp. 4286-4296.

Lindroth et al., "Requirement of CHROMOMETHYLASE3 for Maintenance of CpXpG Methylation", Science, vol. 292, Jun. 15, 2001, pp. 2077-2080.

Lister et al., "Highly Integrated Single-Base Resolution Maps of the Epigenome in *Arabidopsis*", Cell, vol. 133, May 2, 2008, pp. 523-536.

Liu et al., "An Atypical Component of RNA-Directed DNA Methylation Machinery has both DNA Methylation-Dependent and -Independent Roles in Locus-Specific Transcriptional Gene Silencing", Cell Research, vol. 21, No. 12, Dec. 2011, pp. 1691-1700.

Luque et al., "A Constitutive Region is Responsible for Nuclear Targeting of 4.1 R: Modulation by Alternative Sequences Results in Differential Intracellular Localization", Journal of Cell Science, vol. 113, 2000, pp. 2485-2496.

Malagnac et al., "An *Arabidopsis* SET Domain Protein required for Maintenance but not Establishment of DNA Methylation", The EMBO Journal, vol. 21, No. 24, 2002, pp. 6842-6852.

Marton et al., "Nontransgenic Genome Modification in Plant Cells", Plant Physiology, vol. 154, Nov. 2010, pp. 1079-1087.

McCabe et al., "Stable Transformation of Soybean (*Glycine max*) by Particle Acceleration", Bio/Technology, vol. 6, Aug. 1988, pp. 923-926.

McCormick et al., "Leaf Disc Transformation of Cultivated Tomato (*L. esculentum*) using Agrobacterium Tumefaciens", Plant Cell Reports, vol. 5, 1986, pp. 81-84.

McElroy et al., "Isolation of an Efficient Actin Promoter for Use in Rice Transformation", The Plant Cell, vol. 2, Feb. 1990, pp. 163-171.

Moissiard et al., "MORC Family ATPases Required for Heterochromatin Condensation and Gene Silencing", Science, vol. 336, No. 6087, Jun. 15, 2012, pp. 1448-1451.

Mosher et al., "PolIVb Influences RNA-Directed DNA Methylation Independently of its Role in siRNA Biogenesis", PNAS, vol. 105, No. 8, Feb. 26, 2008, pp. 3145-3150.

Mukherjee et al., "A Comprehensive Classification and Evolutionary Analysis of Plant Homeobox Genes", Mol. Biol. Evol., vol. 26, No. 12, 2009, pp. 2775-2794.

Murray et al., "Codon Usage in Plant Genes", Nucleic Acids Research, vol. 17, No. 2, 1989, pp. 477-498.

Nady et al., "Recognition of Multivalent Histone States Associated with Heterochromatin by UHRF1 Protein", The Journal of Biological Chemistry, vol. 286, No. 27, Jul. 8, 2011, pp. 24300-24311.

Needleman et al., "A General Method Applicable to the Search for Similarities in the Amino Acid Sequence of Two Proteins", Journal of Molecular Biology, vol. 48, 1970, pp. 443-453.

Odell et al., "Identification of DNA Sequences required for Activity of the Cauliflower Mosaic Virus 35S Promoter", Nature, vol. 313, Feb. 28, 1985, pp. 810-812.

Olovnikov et al., "Small RNA in the Nucleus: The RNA-Chromatin Ping-Pong", Curr Opin Genet Dev., vol. 22, No. 2, Apr. 2012, pp. 164-171.

Otwinowski et al., "Processing of X-ray Diffraction Data Collected in Oscillation Mode", Methods in Enzymology, vol. 276, 1997, pp. 307-326.

Paszkowski et al., "Direct Gene Transfer to Plants", The EMBO Journal, vol. 3, No. 12, 1984, pp. 2717-2722.

Pearson et al., "Improved Tools for Biological Sequence Comparison", Proc. Natl. Acad. Sci., vol. 85, Apr. 1988, pp. 2444-2448.

Pélissier et al., "A DNA Target of 30 bp is Sufficient for RNA-Directed DNA Methylation", RNA, vol. 6, 2000, pp. 55-65.

Pikaard et al., "Roles of RNA Polymerase IV in Gene Silencing", Trends Plant Sci., vol. 13, No. 7, Jul. 2008, pp. 390-397.

Pontes et al., "The *Arabidopsis* Chromatin-Modifying Nuclear siRNA Pathway Involves a Nucleolar RNA Processing Center", Cell, vol. 126, Jul. 14, 2006, pp. 79-92.

Pontier et al., "Reinforcement of Silencing at Transposons and Highly Repeated Sequences requires the Concerted Action of Two Distinct RNA Polymerases IV in *Arabidopsis*", Genes & Development, vol. 19, 2005, pp. 2030-2040.

Rajakumara et al., "A Dual Flip-Out Mechanism for 5mC Recognition by the *Arabidopsis* SUVH5 SRA Domain and its Impact on DNA Methylation and H3K9 Dimethylation in Vivo", Genes & Development, vol. 25, 2011, pp. 137-152.

Reiss et al., "Regions in the Transit Peptide of SSU Essential for Transport into Chloroplasts", Mol. Gen. Genet., vol. 209, 1987, pp. 116-121.

Riggs et al., "Stable Transformation of Tobacco by Electroporation: Evidence for Plasmid Concatenation", Proc. Natl. Acad. Sci., vol. 83, Aug. 1986, pp. 5602-5606.

Rincon-Arano et al., "UpSET Recruits HDAC Complexes and Restricts Chromatin Accessibility and Acetylation at Promoter Regions", Cell, vol. 151, Dec. 7, 2012, pp. 1214-1228.

Rogers et al., "Improved Vectors for Plant Transformation: Expression Cassette Vectors and New Selectable Markers", Methods in Enzymology, vol. 153, 1987, pp. 253-277.

Sanjana et al., "A Transcription Activator-Like Effector Toolbox for Genome Engineering", Nature Protocols, vol. 7, No. 1, 2012, pp. 171-192.

Schardl et al., "Design and Construction of a Versatile System for the Expression of Foreign Genes in Plants", Gene, vol. 61, 1987, pp. 1-11.

Settles et al., "Old and New Pathways of Protein Export in Chloroplasts and Bacteria", Trends in Cell Biology, vol. 8, Dec. 1998, pp. 494-501.

Smith et al., "The Chromatin Signaling Pathway: Diverse Mechanisms of Recruitment of Histone-Modifying Enzymes and Varied Biological Outcomes", Molecular Cell, vol. 40, Dec. 10, 2010, pp. 689-701.

Soppe et al., "The Late Flowering Phenotype of fwa Mutants is Caused by Gain-of-Function Epigenetic Alleles of a Homeodomain Gene", Molecular Cell, vol. 6, Oct. 2000, pp. 791-802.

Springer et al., "Comparative Analysis of SET Domain Proteins in Maize and *Arabidopsis* Reveals Multiple Duplications Preceding the Divergence of Monocots and Dicots", Plant Physiology, vol. 132, Jun. 2003, pp. 907-925.

Stroud et al., "Comprehensive Analysis of Silencing Mutants Reveals Complex Regulation of the *Arabidopsis* Methylome", Cell, vol. 152, Jan. 17, 2013, pp. 352-364.

Taverna et al., "How Chromatin-Binding Modules Interpret Histone Modifications: Lessons from Professional Pocket Pickers", Nat Struct Mol Biol., vol. 14, No. 11, Nov. 2007, pp. 1025-1040.

Valton et al., "Overcoming Transcription Activator-like, Effector (TALE) DNA Binding Domain Sensitivity to Cytosine Methylation*", The Journal of Biological Chemistry, vol. 287, No. 46, Nov. 9, 2012, pp. 38427-38432.

Velten et al., "Isolation of a Dual Plant Promoter Fragment from the Ti Plasmid of Agrobacterium tumefaciens", The EMBO Journal, vol. 3, No. 12, 1984, pp. 2723-2730.

Walker et al., "DNA Sequences required for Anaerobic Expression of the Maize Alcohol Dehydrogenase 1 Gene", Proc. Natl. Acad. Sci., vol. 84, Oct. 1987, pp. 6624-6628.

(56) References Cited

OTHER PUBLICATIONS

Wang et al., "Characterization of cis-Acting Elements Regulating Transcription from the Promoter of a Constitutively Active Rice Actin Gene", Molecular and Cellular Biology, vol. 12, No. 8, Aug. 1992, pp. 3399-3406.
Wierzbicki et al., "Noncoding Transcription by RNA Polymerase Pol IVb/Pol V Mediates Transcriptional Silencing of Overlapping and Adjacent Genes", Cell, vol. 135, Nov. 14, 2008, pp. 635-648.
Wierzbicki et al., "RNA Polymerase V Transcription Guides ARGONAUTE4 to Chromatin", Nat Genet., vol. 41, No. 5, May 2009, pp. 630-634.
Woo et al., "Three SRA-Domain Methylcytosine-Binding Proteins Cooperate to Maintain Global CpG Methylation and Epigenetic Silencing in *Arabidopsis*", PLoS Genetics, vol. 4, No. 8, e1000156, Aug. 2008, pp. 1-13.
Wu et al., "Structural Biology of Human H-3K9 Methyltransferases", PLoS One, vol. 5, No. 1, e8570, Jan. 2010, pp. 1-10.
Xie et al., "Genetic and Functional Diversification of Small RNA Pathways in Plants", PLoS Biology, vol. 2, No. 5, May 2004, pp. 0642-0652.
Zhang et al., "Genome-Wide Analysis of Mono-, Di- and Trimethylation of Histone H3 Lysine 4 in *Arabidopsis thaliana*", Genome Biology, vol. 10, No. 6, Article R62, 2009, pp. R62.1-R62.14.
Zhang et al., "Genome-Wide High-Resolution Mapping and Functional Analysis of DNA Methylation in *Arabidopsis*", Cell, vol. 126, Sep. 22, 2006, pp. 1189-1201.
Zhang et al., "Role of RNA Polymerase IV in Plant Small RNA Metabolism", PNAS, vol. 104, No. 11, Mar. 13, 2007, pp. 4536-4541.
Zhang et al., "Structural Basis for the Product Specificity of Histone Lysine Methyltransferases", Molecular Cell, vol. 12, Jul. 2003, pp. 177-185.
Zhang et al., "Structure of the Neurospora SET Domain Protein DIM-5, a Histone H3 Lysine Methyltransferase", Cell, vol. 111, No. 1, Oct. 4, 2002, pp. 117-127.
Zhong et al., "DDR Complex Facilitates Global Association of RNA Polymerase V to Promoters and Evolutionarily Young Transposons", Nature Structural & Molecular Biology, vol. 19, No. 9, Sep. 2012, pp. 870-875.
Zilberman et al., "ARGONAUTE4 Control of Locus-Specific siRNA Accumulation and DNA and Histone Methylation", Science, vol. 299, Jan. 31, 2003, pp. 716-719.
Zilberman et al., "Role of *Arabidopsis* ARGONAUTE4 in RNA-Directed DNA Methylation Triggered by Inverted Repeats", Current Biology, vol. 14, Jul. 13, 2004, pp. 1214-1220.
Kanno et al., "RNA-Directed DNA Methylation and Plant Development require an IWR1-Type Transcription Factor", EMBO Reports, vol. 11, No. 1, 2010, pp. 65-71.
Matzke et al., "RNA-Mediated Chromatin-Based Silencing in Plants", Current Opinion in Cell Biology, vol. 21, 2009, pp. 367-376.

\* cited by examiner

E

H3(1-15)K9me2

F

H3(1-15)K9me2

G

H3(1-15)K4me1K9me1

H

I

J

D

E

A

B

C

| Protein | Accession | Spectra | | NSAF | | % of DRD1 | |
|---|---|---|---|---|---|---|---|
| | | Rep1 | Rep2 | Rep1 | Rep2 | Rep1 | Rep2 |
| DRD1 | AT2G16390 | 245 | 245 | 2467.51 | 2737.97 | 100 | 100 |
| DMS3 | AT3G49250 | 115 | 229 | 2448.80 | 1405.46 | 99.24 | 51.33 |
| RDM1 | AT3G22680 | 48 | 28 | 2633.66 | 936.19 | 106.73 | 34.19 |
| NRPE1 | AT2G40030 | 45 | 12 | 203.67 | 33.10 | 8.25 | 1.21 |
| NRPE2 | AT3G23780 | 20 | 14 | 152.62 | 65.10 | 6.19 | 2.38 |
| NRPE3A | AT2G15430 | 14 | 18 | 392.50 | 307.52 | 15.91 | 11.23 |
| NRPE3B | AT2G15400 | 5 | 10 | 140.18 | 170.85 | 5.68 | 6.24 |
| NRPE5 | AT3G57080 | 3 | 0 | 114.98 | 0 | 4.66 | 0 |
| NRPE7 | AT4G14660 | 2 | 5 | 95.60 | 153.09 | 3.87 | 5.59 |
| NRPE9A | AT3G16980 | 3 | 0 | 223.92 | 0 | 9.07 | 0 |
| SUVH2 | AT2G33290 | 6 | 3 | 82.43 | 25.12 | 3.34 | 0.92 |

METHODS AND COMPOSITIONS FOR TARGETING RNA POLYMERASES AND NON-CODING RNA BIOGENESIS TO SPECIFIC LOCI

CROSS-REFERENCE TO RELATED APPLICATION(S)

This is a U.S. National Phase patent application of PCT/US2014/019666, filed Feb. 28, 2014, which claims the benefit of U.S. Provisional Application No. 61/771,743, filed Mar. 1, 2013, and U.S. Provisional Application No. 61/929,414, filed Jan. 20, 2014, which are both hereby incorporated herein by reference in their entirety.

STATEMENT REGARDING FEDERALLY-SPONSORED RESEARCH

This invention was made with government support under Grant No. GM60398, awarded by the National Institutes of Health. The government has certain rights in the invention.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 262232000400SEQLISTING.txt, date recorded: Aug. 27, 2015, size: 744 KB).

FIELD

The present disclosure relates to recombinant proteins that induce epigenetic gene silencing and to methods of using such proteins for reducing the expression of genes in plants.

BACKGROUND

Epigenetic marks are enzyme-mediated chemical modifications of DNA and of its associated chromatin proteins. Although epigenetic marks do not alter the primary sequence of DNA, they do contain heritable information and play key roles in regulating genome function. Such modifications, including cytosine methylation, posttranslational modifications of histone tails and the histone core, and the positioning of nucleosomes (histone octamers wrapped with DNA), influence the transcriptional state and other functional aspects of chromatin. For example, methylation of DNA and certain residues on the histone H3 N-terminal tail, such as H3 lysine 9 (H3K9), are important for transcriptional gene silencing and the formation of heterochromatin. Such marks are essential for the silencing of nongenic sequences, including transposons, pseudogenes, repetitive sequences, and integrated viruses, that become deleterious to cells if expressed and hence activated. Epigenetic gene silencing is also important in developmental phenomena such as imprinting in both plants and mammals, as well as in cell differentiation and reprogramming.

Different pathways involved in epigenetic silencing have been previously described, and include histone deacetylation, H3K27 and H3K9 methylation, H3K4 demethylation, and DNA methylation of promoters. An avenue to achieve DNA methylation is via a phenomenon known as RNA-directed DNA methylation, where non-coding RNAs act to direct methylation of a DNA sequence. In plants, no proteins have been described that link the recognition of a specific DNA sequence with the establishment of an epigenetic state. Thus, plant epigenetic regulators generally cannot be used for epigenetic silencing of specific genes or transgenes in plants.

One solution is to identify or engineer epigenetic regulators that contain sequence-specific zinc finger domains, since zinc fingers were first identified as DNA-binding motifs (Miller et al., 1985), and numerous other variations of them have been characterized. Recent progress has been made that allows the engineering of DNA-binding proteins that specifically recognize any desired DNA sequence. For example, it was recently shown that a three-finger zinc finger protein could be constructed to block the expression of a human oncogene that was transformed into a mouse cell line (Choo and Klug, 1994). However, potential problems to engineering epigenetic regulators that contain an engineered zinc finger domain include ensuring that the engineered protein will have the correct folding to be functional, and ensuring that the fusion of the zinc finger domain to the epigenetic regulator does not interfere with either the DNA-specific binding of the zinc finger domain or the activity of the epigenetic regulator.

Accordingly, a need exists for improved epigenetic regulators that are capable of binding specific DNA sequences, that fold properly, and that retain both the sequence-specific DNA-binding activity and epigenetic gene silencing activity when expressed in plants.

BRIEF SUMMARY

The present disclosure relates to a method for reducing expression of one or more target nucleic acids in a plant, including: a) providing a plant containing a recombinant nucleic acid, where the recombinant nucleic acid encodes a recombinant polypeptide including a first amino acid sequence including a DNA-binding domain and a second amino acid sequence including an SHH1 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes at least one of a homeodomain or a SAWADEE domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 1. In some embodiments that may be combined with any of the preceding embodiments, the second amino acid sequence includes an amino acid sequence that is 100% identical to SEQ ID NO: 1. In some embodiments that may be combined with any of the preceding embodiments, the recombinant polypeptide interacts with an RNA polymerase. In some embodiments, the RNA polymerase is RNA polymerase IV. In some embodiments that may be combined with any of the preceding embodiments, the recombinant polypeptide interacts with methylated H3K9. In some embodiments that may be combined with any of the preceding embodiments, the recombinant polypeptide interacts with H3K9me1, H3K9me2, and/or H3K9me3. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, the one or more target nucleic acids is silenced.

The present disclosure further relates to a recombinant nucleic acid encoding an SHH1-like protein containing a first amino acid sequence including a DNA-binding domain and a second amino acid sequence including an SHH1 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 1. In some embodiments, the second amino acid sequence includes an amino acid sequence that is 100% identical to SEQ ID NO: 1. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the SHH1-like protein reduces expression of the one or more target nucleic acids. In some embodiments that may be combined with any of the preceding embodiments, the SHH1-like protein silences expression of the one or more target nucleic acids.

Other aspects of the present disclosure relate to a vector containing the recombinant nucleic acid encoding the SHH1-like protein of any of the preceding embodiments, where the recombinant nucleic acid is operably linked to a regulatory sequence. Other aspects of the present disclosure relate to a host cell containing the expression vector of the preceding embodiment. In certain embodiments, the host cell is a plant cell. Other aspects of the present disclosure relate to a recombinant plant containing the recombinant nucleic acid of any of the preceding embodiments.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including a SUVH2 polypeptide or a fragment thereof, or a SUVH9 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 14 or SEQ ID NO: 27. In some embodiments that may be combined with any of the preceding embodiments, the second amino acid sequence includes an amino acid sequence that is 100% identical to SEQ ID NO: 14 or SEQ ID NO: 27. In some embodiments that may be combined with any of the preceding embodiments, the recombinant polypeptide interacts with an RNA polymerase. In some embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced. In some embodiments that may be combined with any of the preceding embodiments, the method includes providing a plant that further includes an additional recombinant nucleic acid, where the additional recombinant nucleic acid encodes a recombinant polypeptide including a first amino acid sequence including a DNA-binding domain and a second amino acid sequence including an SHH1 polypeptide or a fragment thereof; and growing the plant under conditions where the additional recombinant polypeptide encoded by the additional recombinant nucleic acid is expressed and binds to the one or more target nucleic acids, thereby reducing expression of the one or more target nucleic acids.

The present disclosure further relates to a recombinant nucleic acid encoding a SUVH2-like protein or a SUVH9-like protein including a first amino acid sequence including a DNA-binding domain and a second amino acid sequence including a SUVH2 polypeptide or a fragment thereof, or a SUVH9 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 14 or SEQ ID NO: 27. In some embodiments, the second amino acid sequence includes an amino acid sequence that is 100% identical to SEQ ID NO: 14 or SEQ ID NO: 27. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the SUVH2-like protein and/or the SUVH9-like protein reduces expression of the one or more target nucleic acids. In some embodiments that may be combined with any of the preceding embodiments, the SUVH2-like protein and/or the SUVH9-like protein silences expression of the one or more target nucleic acids.

Other aspects of the present disclosure relate to a vector containing the recombinant nucleic acid encoding the SUVH2-like protein and/or the SUVH9-like protein of any of the preceding embodiments, where the recombinant nucleic acid is operably linked to a regulatory sequence. Other aspects of the present disclosure relate to a host cell containing the expression vector of the preceding embodiment. In certain embodiments, the host cell is a plant cell. Other aspects of the present disclosure relate to a recombinant plant containing the recombinant nucleic acid of any of the preceding embodiments.

The present disclosure is further related to a method for reducing expression of one or more target nucleic acids in a plant, including: a) providing a plant including a first recombinant nucleic acid encoding a first recombinant polypeptide including a first amino acid sequence including a DNA-binding domain and a second amino acid sequence including an SHH1 polypeptide or a fragment thereof, and a second recombinant nucleic acid encoding a second recombinant polypeptide including a first amino acid sequence including a DNA-binding domain and a second amino acid sequence including a SUVH2 polypeptide or a fragment thereof, or a SUVH9 polypeptide or a fragment thereof; and b) growing the plant under conditions where the first recombinant polypeptide encoded by the first recombinant nucleic acid and the second recombinant polypeptide encoded by the second recombinant nucleic acid are expressed and bind to the one or more target nucleic acids, thereby reducing expression of the one or more target nucleic acids. In some embodiments, the DNA-binding domain of at least one of the recombinant polypeptides includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain from at least one of the recombinant polypeptides is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain of at least one of the recombinant polypeptides includes a TAL effector targeting domain. In some embodiments that may be combined with any of the preceding embodiments, the DNA-binding domain of at least one of the recombinant polypeptides includes three C2H2 zinc finger domains. In some embodiments that may be combined with any of the preceding embodiments, the second amino acid sequence of the first recombinant polypeptide includes at least one of a homeodomain or a SAWADEE domain. In some embodiments that may be combined with any of the preceding embodiments, the second amino acid sequence of the first recombinant polypeptide includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 1. In some embodiments that may be combined with any of the preceding embodiments, the second amino acid sequence of the first recombinant polypeptide includes an amino acid sequence that is 100% identical to SEQ ID NO: 1. In some embodiments that may be combined with any of the preceding embodiments, at least one of the recombinant polypeptide interacts with an RNA polymerase. In some embodiments, the RNA polymerase is RNA polymerase IV. In some embodiments that may be combined with any of the preceding embodiments, the first recombinant polypeptide interacts with methylated H3K9. In some embodiments that may be combined with any of the preceding embodiments, the first recombinant polypeptide interacts with H3K9me1, H3K9me2, and/or H3K9me3. In some embodiments that may be combined with any of the preceding embodiments, the first recombinant polypeptide induces RNA-directed DNA methylation. In some embodiments that may be combined with any of the preceding embodiments, the second amino acid sequence of the second recombinant polypeptide includes a domain selected from a two-helix bundle domain, a SRA domain, a pre-SET domain, or a SET domain. In some embodiments that may be combined with any of the preceding embodiments, the second amino acid sequence from the second recombinant polypeptide includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 14 or SEQ ID NO: 27. In some embodiments that may be combined with any of the preceding embodiments, the second amino acid sequence of the second recombinant polypeptide includes an amino acid sequence that is 100% identical to SEQ ID NO: 14 or SEQ ID NO: 27. In some embodiments that may be combined with any of the preceding embodiments, the second recombinant polypeptide interacts with an RNA polymerase. In some embodiments, the RNA polymerase is RNA polymerase V. In some embodiments that may be combined with any of the preceding embodiments, the second recombinant polypeptide induces RNA-directed DNA methylation. In some embodiments that may be combined with any of the preceding embodiments, at least one of the recombinant polypeptides induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, the one or more target nucleic acids is silenced.

Other aspects of the present disclosure relate to a vector containing the recombinant nucleic acid encoding the SHH1-like protein, the SUVH2-like protein and/or the SUVH9-like protein of any of the preceding embodiments, where the recombinant nucleic acid is operably linked to a regulatory sequence. Other aspects of the present disclosure relate to a host cell containing the expression vectors of the preceding embodiment. In certain embodiments, the host cell is a plant cell. Other aspects of the present disclosure relate to a recombinant plant containing the recombinant nucleic acids of any of the preceding embodiments.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including a DMS3 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 41. In some embodiments that may be combined with any of the preceding embodiments, the second amino acid sequence includes an amino acid sequence that is 100% identical to SEQ ID NO: 41. In some embodiments that may be combined with any of the preceding embodiments, the recombinant polypeptide interacts with an RNA polymerase. In some embodiments that may be combined with any of the preceding embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure further relates to a recombinant nucleic acid encoding a DMS3-like protein including a first amino acid sequence including a DNA-binding domain and a second amino acid sequence including a DMS3 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 41. In some embodiments, the second amino acid sequence includes an amino acid sequence that is 100% identical to SEQ ID NO: 41. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the DMS3-like protein reduces expression of the one or more target nucleic acids. In some embodiments that may be combined with any of the preceding embodiments, the DMS3-like protein silences expression of the one or more target nucleic acids.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including a MORC6 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 53. In some embodiments that may be combined with any of the preceding embodiments, the second amino acid sequence includes an amino acid sequence that is 100% identical to SEQ ID NO: 53. In some embodiments that may be combined with any of the preceding embodiments, the recombinant polypeptide interacts with an RNA polymerase. In some embodiments that may be combined with any of the preceding embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure further relates to a recombinant nucleic acid encoding a MORC6-like protein including a first amino acid sequence including a DNA-binding domain and a second amino acid sequence including a MORC6 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 53. In some embodiments, the second amino acid sequence includes an amino acid sequence that is 100% identical to SEQ ID NO:

53. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the MORC6-like protein reduces expression of the one or more target nucleic acids. In some embodiments that may be combined with any of the preceding embodiments, the MORC6-like protein silences expression of the one or more target nucleic acids.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including a SUVR2 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 66. In some embodiments that may be combined with any of the preceding embodiments, the second amino acid sequence includes an amino acid sequence that is 100% identical to SEQ ID NO: 66. In some embodiments that may be combined with any of the preceding embodiments, the recombinant polypeptide interacts with an RNA polymerase. In some embodiments that may be combined with any of the preceding embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure further relates to a recombinant nucleic acid encoding a SUVR2-like protein including a first amino acid sequence including a DNA-binding domain and a second amino acid sequence including a SUVR2 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 66. In some embodiments, the second amino acid sequence includes an amino acid sequence that is 100% identical to SEQ ID NO: 66. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the SUVR2-like protein reduces expression of the one or more target nucleic acids. In some embodiments that may be combined with any of the preceding embodiments, the SUVR2-like protein silences expression of the one or more target nucleic acids.

Other aspects of the present disclosure relate to a vector containing the recombinant nucleic acid encoding a DMS3-like, MORC6-like, and/or SUVR2-like protein of any of the preceding embodiments, where the recombinant nucleic acid is operably linked to a regulatory sequence. Other aspects of the present disclosure relate to a host cell containing the expression vector of the preceding embodiment. In certain embodiments, the host cell is a plant cell. Other aspects of the present disclosure relate to a recombinant plant containing the recombinant nucleic acid of any of the preceding embodiments.

The present disclosure further relates to a method for reducing expression of one or more target nucleic acids in a plant, including: (a) providing a plant including a first recombinant nucleic acid encoding a first recombinant polypeptide including a first amino acid sequence including a DNA-binding domain and a second amino acid sequence including an SHH1 polypeptide or a fragment thereof, and one or more additional recombinant nucleic acids encoding one or more additional polypeptides, each of the one or more additional polypeptides including a first amino acid sequence including a DNA-binding domain and a second amino acid sequence including a polypeptide selected from the group consisting of a SUVH2 polypeptide or a fragment thereof, a SUVH9 polypeptide or a fragment thereof, a DMS3 polypeptide or a fragment thereof, a MORC6 polypeptide or a fragment thereof, a SUVR2 polypeptide or a fragment thereof, a DRD1 polypeptide or a fragment thereof, an RDM1 polypeptide or a fragment thereof, a DRM3 polypeptide or a fragment thereof, a DRM2 polypeptide or a fragment thereof, and an FRG polypeptide or a fragment thereof and; and (b) growing the plant under conditions where the first recombinant polypeptide encoded by the first recombinant nucleic acid and the one or more additional polypeptides encoded by the one or more additional recombinant nucleic acids are expressed and bind to the one or more target nucleic acids, thereby reducing expression of the one or more target nucleic acids. In some embodiments, at least one of the recombinant polypeptides induces RNA-directed DNA methylation. In some embodiments, the one or more target nucleic acids are endogenous nucleic acids. In some embodiments, the one or more target nucleic acids are heterologous nucleic acids. In some embodiments, expression of the one or more target nucleic acids is silenced.

Other aspects of the disclosure relate to a host cell including expression vectors including the recombinant nucleic acids encoding the recombinant polypeptides of any one of the preceding embodiments. In some embodiments, the host cell is a plant cell. Other aspects of the disclosure relate to a recombinant plant including the recombinant nucleic acids of any one of the preceding embodiments.

The present disclosure further relates to a method for reducing expression of one or more target nucleic acids in a plant, including providing a plant including: (a) a small interfering RNA (siRNA) which targets one or more target nucleic acids, and one or more recombinant nucleic acids encoding one or more polypeptides, each of the one or more polypeptides including a first amino acid sequence including a DNA-binding domain and a second amino acid sequence including a polypeptide selected from the group consisting of a SUVH2 polypeptide or a fragment thereof, a SUVH9 polypeptide or a fragment thereof, a DMS3 polypeptide or a fragment thereof, a MORC6 polypeptide or a fragment thereof, a SUVR2 polypeptide or a fragment thereof, a DRD1 polypeptide or a fragment thereof, an RDM1 polypeptide or a fragment thereof, a DRM3 polypeptide or a fragment thereof, a DRM2 polypeptide or a fragment thereof, and an FRG polypeptide or a fragment thereof and (b) growing the plant under conditions whereby the siRNA interacts with the one or more target nucleic acids and the one or more polypeptides encoded by the one or more recombinant nucleic acids are expressed and bind to the one or more target nucleic acids, thereby reducing expression of the one or more target nucleic acids.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including a DRD1 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 79. In some embodiments that may be combined with any of the preceding embodiments, the second amino acid sequence includes an amino acid sequence that is 100% identical to SEQ ID NO: 79. In some embodiments that may be combined with any of the preceding embodiments, the recombinant polypeptide interacts with an RNA polymerase. In some embodiments that may be combined with any of the preceding embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure further relates to a recombinant nucleic acid encoding a DRD1-like protein including a first amino acid sequence including a DNA-binding domain and a second amino acid sequence including a DRD1 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 79. In some embodiments, the second amino acid sequence includes an amino acid sequence that is 100% identical to SEQ ID NO: 79. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the DRD1-like protein reduces expression of the one or more target nucleic acids. In some embodiments that may be combined with any of the preceding embodiments, the DRD1-like protein silences expression of the one or more target nucleic acids.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including an RDM1 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 91. In some embodiments that may be combined with any of the preceding embodiments, the second amino acid sequence includes an amino acid sequence that is 100% identical to SEQ ID NO: 91. In some embodiments that may be combined with any of the preceding embodiments, the recombinant polypeptide interacts with an RNA polymerase. In some embodiments that may be combined with any of the preceding embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure further relates to a recombinant nucleic acid encoding an RDM1-like protein including a first amino acid sequence including a DNA-binding domain and a second amino acid sequence including an RDM1 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 91. In some embodiments, the second amino acid sequence includes an amino acid sequence that is 100% identical to SEQ ID NO: 91. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the RDM1-like protein reduces expression of the one or more target nucleic acids. In some embodiments that may be combined with any of the preceding embodiments, the RDM1-like protein silences expression of the one or more target nucleic acids.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including a DRM3 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 101. In some embodiments that may be combined with any of the preceding embodiments, the second amino acid sequence includes an amino acid sequence that is 100% identical to SEQ ID NO: 101. In some embodiments that may be combined with any of the preceding embodiments, the recombinant polypeptide interacts with an RNA polymerase. In some embodiments that may be combined with any of the preceding embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure further relates to a recombinant nucleic acid encoding a DRM3-like protein including a first amino acid sequence including a DNA-binding domain and a second amino acid sequence including a DRM3 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 101. In some embodiments, the second amino acid sequence includes an amino acid sequence that is 100% identical to SEQ ID NO: 101. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the DRM3-like protein reduces expression of the one or more target nucleic acids. In some embodiments that may be combined with any of the preceding embodiments, the DRM3-like protein silences expression of the one or more target nucleic acids.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including a DRM2 polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 113. In some embodiments that may be combined with any of the preceding embodiments, the second amino acid sequence includes an amino acid sequence that is 100% identical to SEQ ID NO: 113. In some embodiments that may be combined with any of the preceding embodiments, the recombinant polypeptide interacts with an RNA polymerase. In some embodiments that may be combined with any of the preceding embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure further relates to a recombinant nucleic acid encoding a DRM2-like protein including a first amino acid sequence including a DNA-binding domain and a second amino acid sequence including a DRM2 polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 113. In some embodiments, the second amino acid sequence includes an amino acid sequence that is 100% identical to SEQ ID NO: 113. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the DRM2-like protein reduces expression of the one or more target nucleic acids. In some embodiments that may be combined with any of the preceding embodiments, the DRM2-like protein silences expression of the one or more target nucleic acids.

The present disclosure further relates to a method for reducing expression of one or more target nucleic acids in a plant, including: a) providing a plant containing a recombinant nucleic acid, wherein the recombinant nucleic acid encodes a recombinant polypeptide including a first amino acid sequence including a DNA-binding domain and a second amino acid sequence including an FRG polypeptide or a fragment thereof; and b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a Cys2His2 (C2H2) zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain includes three C2H2 zinc finger domains. In some embodiments that may be combined with any of the preceding embodiments, the second amino acid sequence includes a domain selected from a two-helix bundle domain, a SRA domain, a pre-SET domain, or a SET domain. In some embodiments that may be combined with any of the preceding embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 125. In some embodiments that may be combined with any of the preceding embodiments, the second amino acid sequence includes an amino acid sequence that is 100% identical to SEQ ID NO: 125. In some embodiments that may be combined with any of the preceding embodiments, the recombinant polypeptide interacts with an RNA polymerase. In some embodiments that may be combined with any of the preceding embodiments, the RNA polymerase is RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure further relates to a recombinant nucleic acid encoding an FRG-like protein including a first amino acid sequence including a DNA-binding domain and a second amino acid sequence including a FRG polypeptide or a fragment thereof. In some embodiments, the second amino acid sequence includes an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 125. In some embodiments, the second amino acid sequence includes an amino acid sequence that is 100% identical to SEQ ID NO: 125. In some embodiments that may be combined with any of the preceding embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from a C2H2 zinc finger domain, a CCCH zinc finger domain, a multi-cysteine zinc finger domain, and a zinc binuclear cluster domain. In some embodiments that may be combined with any of the preceding embodiments, the DNA-binding domain is selected from a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments that may be combined with any of the preceding embodiments, the DNA-binding domain includes a TAL effector targeting domain. In some embodiments that may be combined with any of the preceding embodiments, the DNA-binding domain binds one or more target nucleic acids. In some embodiments that may be combined with any of the preceding embodiments, the DNA-binding domain binds one or more target nucleic acids. In some embodiments, the one or more target nucleic acids are polypeptide-encoding nucleic acids. In some embodiments, the one or more target nucleic acids are endogenous plant nucleic acids. In some embodiments, the one or more target nucleic acids are heterologous nucleic acids. In some embodiments that may be combined with any of the preceding embodiments, the FRG-like protein reduces expression of the one or more target nucleic acids. In some embodiments that may be combined with any of the preceding embodiments, the FRG-like protein silences expression of the one or more target nucleic acids.

Other aspects of the present disclosure relate to a plant having reduced expression of one or more target nucleic acids according to the method of any one of the preceding embodiments, as well as a progeny plant of the plant of the preceding embodiment. In some embodiments, the progeny plant has reduced expression of the one or more target nucleic acids and does not include the recombinant nucleic acids of the present disclosure.

BRIEF DESCRIPTION OF THE DRAWINGS

The patent or application file contains at least one drawing executed in color. Copies of this patent or patent application publication with color drawings will be provided by the office upon request and payment of the necessary fee.

FIG. 1A illustrates a pie chart showing the abundance of 24 nt siRNA reads (U.S. Pat. No. 5,967,213 uniquely mapping reads total) within the indicated categories. FIG. 1B illustrates a Venn diagram showing the approximate relationships of 24 nt siRNA clusters reduced in each genotype and the subclasses used for downstream analysis. FIG. 1C illustrates pie charts showing the chromosomal distribution (based on the previously described definitions of pericentromeric heterochromatin and euchromatin) of affected siRNA clusters in the indicated subclasses. FIG. 1D and FIG. 1E illustrate boxplots of siRNA and CHH methylation patterns at the subclasses shown in FIG. 1B for the different RdDM mutants (* indicates significant reduction; P<1e-10 Mann-Whitney U test). FIG. 1F illustrates metaplots showing the enrichment of CMT3, and Pol-V at affected siRNA clusters (+/−5000 bp from the midpoint of the sRNA cluster). FIG. 1G illustrates heatmaps of Pol-V enrichment over affected siRNA clusters.

FIG. 2A illustrates metaplots and FIG. 2B illustrates heatmaps of Pol-IV enrichment over the defined siRNA clusters in the indicated genetic backgrounds. Metaplots and heatmaps extend +/−5000 bp from the midpoint of the siRNA cluster.

FIG. 3A and FIG. 3B illustrates ITC-based measurements of the SAWADEE domain binding to the modified or unmodified histone peptides as indicated. $K_d$ values are listed. FIG. 3C illustrates metaplot analyses showing the enrichment of H3K9me2 over the indicated Pol-IV ChIP-seq peak classes. FIG. 3D illustrates the overall structure of SHH1 SAWADEE domain in the free form. The two tandem Tudor domains are shown in magenta (Tudor 1) and green (Tudor 2). The unique zinc-binding motif of the SAWADEE domain is shown as an enlarged ball-and-stick model, highlighting the details of the metal coordination. A bound detergent molecule 4-Cyclohexyl-1-Butyl-β-D-Maltoside (CY-MAL®-4, Hampton Research) moiety from the crystallization condition is shown in yellow in a stick representation.

FIG. 4A illustrates the overall structure of the H3(1-15)K9me2-SAWADEE complex. The SAWADEE domain is shown as a ribbon diagram and the peptide in a stick representation. The simulated annealing composite omit electron density map at 1σ level of the bound peptide is also shown. Tudor domains 1 and 2 are shown in magenta and green, respectively. FIG. 4B illustrates a stereo view highlighting the details of the intermolecular interactions between the SAWADEE domain and the bound H3(1-15)K9me2 peptide. Intermolecular hydrogen-bonding interactions are designated by dashed red lines. The aromatic cage, which recognizes the dimethylated K9, is also shown. FIG. 4C illustrates a representation of the intermolecular interactions between the SAWADEE domain and the bound H3(1-15)K9me2 peptide. FIG. 4D illustrates a superposition of the H3K9me2 peptide bound SAWADEE domain (with Tudor 1 in magenta and Tudor 2 in green) and the free form of the SAWADEE domain (in silver) reveals no significant overall conformational change upon peptide binding. FIG. 4E illustrates that the unmethylated K4 inserts into a narrow pocket formed by Glu130 and Asp141 from Tudor 1, and Leu201 and Tyr212 from Tudor 2, and forms two hydrogen bonds with Glu130 and Asp141, as well as electrostatics interactions. FIG. 4F illustrates a detailed view of the recognition of the dimethylated K9 by an aromatic cage formed by three aromatic residues. FIG. 4G illustrates that the monomethylated K4 is tolerated by the K4 binding pocket of SAWADEE domain as revealed by the crystal structure of the H3(1-15)K4me1K9me1-SAWADEE complex. The additional methyl group disrupts one hydrogen bond with Glu130 and introduces more van der Waals contacts with other residues. FIG. 4H and FIG. 4I illustrate boxplots showing the % CHH methylation and siRNA levels respectively, in wild-type and shh1 mutants as well as shh1 mutants transformed with SHH1 constructs with either the wild-type SHH1 sequence or point mutations in the K9 (F162AF165A and Y140A) or K4 (D141A and Y212A) binding pockets. (* indicates significant reduction; P<1e-10 Mann-Whitney U test). FIG. 4J illustrates quantitative PCR results showing enrichment of Pol-IV in wild-type and SHH1 mutant backgrounds. Blue bars indicate the average of two biological replicates after normalization to input and the level of actin. Black bars indicate the Standard error.

FIG. 5A illustrates quantitative PCR (qPCR) of IGN22 and P6 relative to ACTIN7 and normalized to Columbia (WT). Mean+/−standard deviation (SD) of two biological replicas. FIG. 5B illustrates qPCR of IGN22 and IGN5 from Flag ChIP shown as enrichment of IP/input relative to ACTIN7 in NRPE1-Flag/WT and NRPE1-Flag/suvh2suvh9 lines. Mean+/−SD of two biological replicas. FIG. 5C illustrates a heat map of NRPE1 enrichment at defined NRPE1 sites determined by Flag ChIP-seq in either NRPE1-Flag/WT or NRPE1-Flag/suvh2suvh9, with Flag ChIP in Columbia as negative control. FIG. 5D illustrates box plot (whiskers extend to ±1.5 interquartile range (IQR)) of NRPE1 enrichment at sites shown in C for NRPE1-Flag/WT and NRPE1-Flag/suvh2suvh9. FIG. 5E illustrates the percent methylation at all defined NRPE1 binding sites (mean+/−SD) as determined by whole-genome bisulfite sequencing. FIG. 5F illustrates the density of H3K9me1 ChIP-seq reads in WT, suvh2suvh9, and suvh4suvh5suvh6, normalized by the mean histone methylation level at 80 selected euchromatic sites.

FIG. 6A, top illustrates a diagram of SUVH2 with Zn Finger inserted immediately before the HA tag at the N-terminus. FIG. 6A, bottom illustrates a schematic of FWA gene showing the two small and two large repeats (blue arrows), the regions amplified by PCR (promoter and transcript), the start of transcription (red arrow) and the sites bound by the Zn finger (indicated by two orange arrows). FIG. 6B illustrates plants grown side-by-side to illustrate early flowering of ZF-SUVH2 in fwa-4 (T2 plants) compared to fwa-4. FIG. 6C illustrates flowering time of Columbia (WT), ZF-SUVH2 in fwa-4, HA-SUVH2 in fwa-4 and fwa-4. Mean+/−SD. FIG. 6D illustrates percent methylation at each C in the FWA repeat region. Numbers indicate individual C residues, two black lines show location of ZF binding sites, red arrow shows the location of transcript. Percent methylation was determined from 20-25 clones of bisulfite-treated DNA. FIG. 6E illustrates percent methylation at each C in the FWA repeat region from three individual T1 plants.

FIG. 7A illustrates NRPE1 ChIP in WT (positive control), nrpe1 mutant (negative control), fwa-4 epiallele, and ZF-SUVH2/fwa-4. qPCR of two characterized NRPE sites (IGN5 and IGN22) and two regions in FWA (FWAp-promoter and FWAt-transcript) shown as enrichment of IP/input relative to negative control. Mean+/−SD of two biological replicas. FIG. 7B illustrates H3K9me1 ChIP in WT, fwa-4 and ZF-SUVH2/fwa-4 T1 flowers. Negative control is a region in euchromatin devoid of DNA methylation. Enrichment is relative to the heterochromatic retrotransposon Ta3. Mean+/−SD of two biological replicas. FIG. 7C illustrates the same as FIG. 7B, but ZF-SUVH2/fwa-4 was from T2 flowers.

FIG. 8A illustrates a color-coded schematic representation of full length SUVH9 and the N-terminally truncated construct used for crystallization. FIG. 8B illustrates a ribbon diagram of the crystal structure of SUVH9 containing a two-helix bundle towards the N-terminus, the SRA domain, the pre-SET domain, and the SET domain colored in pink, green, orange, and blue, respectively. The disordered regions are shown with dashed lines. The $Zn_3Cys_9$ cluster (bottom right of panel) is highlighted with ball-and-stick model. FIG. 8C illustrates the hydrophobic interactions and charged interactions within the two-helix bundle shown in two alternate views rotated by 180°. Residues involved in inter-helix hydrophobic interactions are highlighted in yellow. FIG. 8D illustrates the N-terminal part of the first α-helix forms charged and hydrogen bonding interactions with the SRA domain and the SET domain. The interacting residues are shown in stick representation and the hydrogen-bonding interactions are shown with dashed red lines. FIG. 8E illustrates the C-terminal part of the first α-helix exhibits extensive hydrophobic interactions with the SRA domain and the pre-SET/SET domains. The tip of a long loop from the SET domain covers over the first α-helix and forms hydrophobic interactions with it. The interacting residues are shown in a stick representation. FIG. 8F illustrates the second α-helix forms some interactions with the SRA domain. The interacting residues are shown in stick representation and the hydrogen bonding interactions are shown with red dashes. FIG. 8G illustrates the SRA domain forms a hydrophobic core that interacts with the pre-SET/SET domains and the two-helix bundle. The interacting residues are shown in a stick representation. FIG. 8H illustrates a long insertion loop of SUVH9 SET domain (highlighted in magenta) is enriched with hydrophobic residues and forms extensive hydrophobic interactions with the two-helix bundle, the pre-SET and SET domains.

FIG. 9A illustrates the crystal structure of human GLP in complex with bound SAH (PDB code: 2IGQ) is shown in a silver ribbon representation in the top panel, with an expanded view of its SAH binding site shown in an electrostatic surface representation in the bottom panel. The cofactor SAH is shown in a space-filling representation in both panels. The SAH binding pocket of GLP is relatively narrow and binds to SAH with structural and shape complementarity. FIG. 9B illustrates the crystal structure of SUVH9 in the free-state is shown in a color-coded ribbon representation in the top panel, with an expanded view of the putative SAH binding site shown in an electrostatic surface representation in the bottom panel. The putative SAH binding pocket of SUVH9 is relatively open and does not provide a good fit for the SAH molecule. FIG. 9C illustrates the crystal structure of human GLP in complex with SAH and H3K9me2 peptide (PDB code: 2RFI) is shown in silver ribbon representation in the top panel, with an expanded view of its peptide binding site shown in an electrostatic surface representation in the bottom panel. The post-SET domain and the acidic loop of the SET domain involved in peptide substrate binding are highlighted in cyan and dark blue, respectively. The bound peptide is shown in a space-filling representation in both panels. The peptide is bound in a surface cleft between the post-SET and SET domains. FIG. 9D illustrates the crystal structure of SUVH9 in the free state is shown in a color-coded ribbon representation in the top panel, with an expanded view of the putative peptide-binding site shown in an electrostatic surface representation in the bottom panel. The long insertion loop of the SET domain is highlighted in magenta. The putative peptide-binding site is partially blocked by the long insertion loop and the there is no significant peptide-binding cleft on the protein surface. FIG. 9E illustrates a model positioning the mCHH DNA to the active site of SUVH9 SRA domain following superposition the structures of the SUVH5 SRA-mCHH complex [PDB code: 3Q0F] and SUVH9 in the free-state. The DNA fits well into the SRA domain without significant steric clashes. Some surrounding residues on the second α-helix the two-helix bundle, which can potentially be involved in the binding to the DNA, are highlighted in a stick representation.

FIG. 12A illustrates metaplots of CHH methylation over DMRs identified in the various SUVH mutants. FIG. 12B illustrates metaplots of CHH methylation over Pol V binding sites. FIG. 12C illustrates a Venn diagram detailing the overlaps between CHH hypo-methylated regions in SUVH mutants.

FIG. 13A illustrates a metaplot of percent CHH methylation at all defined NRPE1 binding sites as determined by BS-seq in wild type (WT), nrpe1 and suvh2 suvh9. FIG. 13B illustrates box plots showing DNA methylation in each cytosine context at defined NRPE1 binding sites in WT and met1. FIG. 13C illustrates that Pol V occupancy in met1 is reduced at NRPE1 sites. FIG. 13D illustrates a metaplot of DNA methylation at sites defined as hyper-methylated in met1. FIG. 13E illustrates Pol V occupancy in met1 is increased at defined hyper-methylated sites.

FIG. 14A illustrates percent methylation at each cytosine in the FWA repeat region as determined by BS-seq in T2 and T3 ZF-SUVH2/fwa-4 plants compared to T2 ZF-KYP/fwa-4 (unmethylated) and WT (standard methylation pattern). ZF binding sites are shown in green and the FWA gene in blue. FIG. 14B illustrates results of a pull-down of DRD1-Flag with ZF-SUVH2. Input: DRD1-Flag extract from *Arabidopsis*; Beads-mock: elution from DRD1-Flag pull-down using HAmagnetic beads prebound with *Nicotiana benthamiana* extract; Beads-ZFSUVH2: elution from DRD1-Flag pull-down using HA-magnetic beads prebound with *Nicotiana benthamiana* ZF-SUVH2 extract. Top panel: Flag blot; bottom panel: HA blot.

FIG. 15A illustrates Flag-ChIP in WT versus ZF-KYP (flag-tagged) showing enrichment at FWA in both the promoter and transcript region. FIG. 15B illustrates BS-Seq of FWA from a Basta-resistant line containing the ZF-SUVH2 transgene and two Basta-sensitive siblings which had lost the ZF-SUVH2 transgene. FIG. 15C illustrates a pull-down of HA-SUVH2 in *Arabidopsis* using Flag-DRD1. Left panels are inputs from the two parental strains (expressing either HA-SUVH2 (HA-2) or Flag-DRD1 (Flag-D)) and the F2 line expressing both HA-SUVH2 and Flag DRD1 (HA-2×Flag-d). The right panels show elution off Flag-magnetic beads. Top panels are HA blots, bottom panels are Flag blots.

FIG. 16 illustrates a list of proteins identified by DRD1 immunoprecipitation-mass spectrometry.

DETAILED DESCRIPTION

Overview

Figure 1:
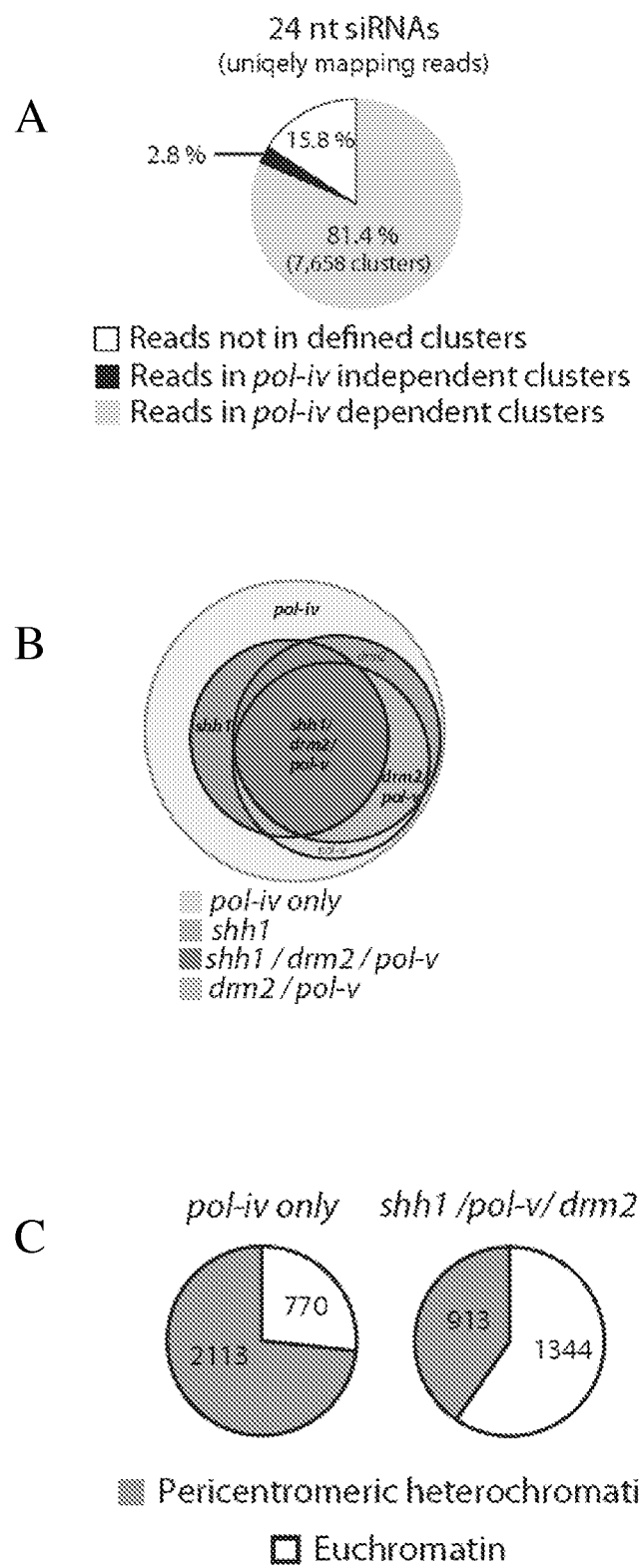
FIG. 1A-FIG. 1G illustrate an epigenetic profile of sRNA clusters affected in RdDM mutants.
Figure 1:
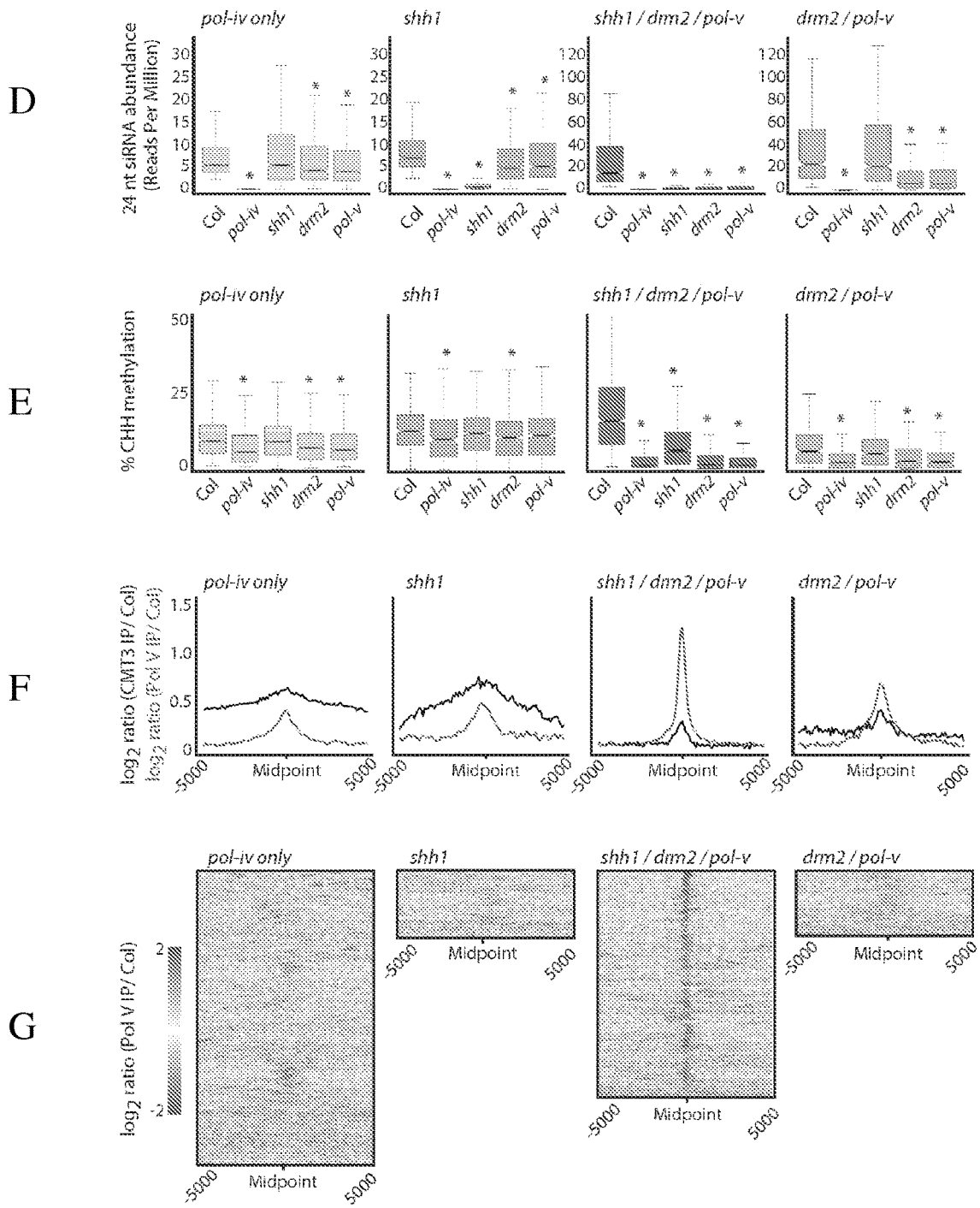

The following description is presented to enable a person of ordinary skill in the art to make and use the various embodiments. Descriptions of specific devices, techniques, methods, and applications are provided only as examples. Various modifications to the examples described herein will be readily apparent to those of ordinary skill in the art, and the general principles defined herein may be applied to other examples and applications without departing from the spirit and scope of the various embodiments. Thus, the various embodiments are not intended to be limited to the examples described herein and shown.

The present disclosure relates to recombinant proteins that induce epigenetic gene silencing and to methods of using such proteins for reducing the expression of genes in plants.

In *Arabidopsis*, DNA methylation is established by a protein called DRM2 and is targeted by 24 nt small interfering RNAs (siRNAs) through a pathway termed RNA-directed DNA methylation (RdDM) that involves two plant-specific RNA polymerases: RNA Polymerase IV (Pol IV), which functions to initiate siRNA biogenesis; and RNA Polymerase V (Pol V), which functions in the downstream DNA methyltransferase targeting phase of the RdDM pathway to generate non-coding scaffold transcripts that recruit downstream RdDM factors. Thus, RNA-directed DNA methylation (RdDM) in *Arabidopsis* involves both the synthesis of non-coding, small-interfering RNAs by Pol IV and the synthesis of non-coding scaffold RNAs by Pol V.

The present disclosure is based, at least in part, on Applicant's discovery that a protein called SHH1 acts in the RdDM pathway to enable siRNA production from RdDM targets and that SHH1 is required for RNA polymerase IV (Pol IV) occupancy at these target loci. The present disclosure is further based, at least in part, on Applicant's discovery that Pol V association with chromatin is dependent on two proteins called SUVH2 and SUVH9. Moreover, a modified SHH1, SUVH2, and/or SUVH9 protein can be engineered to specifically bind different DNA sequences by introducing a heterologous DNA-binding domain into the protein or a fragment of the protein, such as a heterologous zinc finger domain or TAL effector targeting domain. Advantageously, such recombinant proteins can be used to recruit Pol IV (for SHH1-like proteins) or Pol V (for SUVH2-like proteins and/or SUVH9-like proteins) to target loci to induce RNA-directed DNA methylation at the target loci, and thus to silence the target loci.

Other proteins useful in the methods of the present disclosure for targeting Pol V, DNA methylation, and gene silencing to specific loci include any one of a modified DMS3, MORC6, and/or SUVR2 protein, which can also be engineered to specifically bind different DNA sequences by introducing a heterologous DNA-binding domain into the protein or a fragment of the protein, such as a heterologous zinc finger domain or TAL effector targeting domain.

Accordingly, the present disclosure provides methods for silencing specific loci in plants using one or more of an SHH1 protein, a SUVH2 protein, a SUVH9 protein, a DMS3 protein, a MORC6 protein, and/or a SUVR2 protein that have been engineered to specifically bind different DNA sequences via the introduction of a heterologous DNA-binding domain into the protein. Each one of the aforementioned modified proteins may be expressed in a host cell individually or in various combinations to act to silence a target locus. For example, a modified SHH1 protein having a heterologous DNA-binding domain may be expressed in a host cell to target Pol IV to a target locus in conjunction with one or more of a modified SUVH2 protein, SUVH9 protein, DMS3 protein, MORC6 protein, and/or SUVR2 protein having a heterologous DNA-binding domain to target Pol V to that same target locus to trigger RNA-directed DNA methylation and epigenetic silencing of that target locus.

Other proteins that may be useful for silencing specific loci in plants according to the methods of the present disclosure include additional proteins involved in RNA-directed DNA methylation. For example, other suitable proteins for use in the methods of the present disclosure may include, for example, any one of DRD1, RDM1, DRM3, DRM2, and FRG. Accordingly, the present disclosure also provides methods for silencing specific loci in plants using one or more of an SHH1 protein, a SUVH2 protein, a SUVH9 protein, a DMS3 protein, a MORC6 protein, a SUVR2 protein, a DRD1 protein, an RDM1 protein, a DRM3 protein, a DRM2 protein, and/or an FRG protein that have been engineered to specifically bind different DNA sequences via the introduction of a heterologous DNA-binding domain into the protein. Each one of the aforementioned modified proteins may be expressed in a host cell individually or in various combinations to act to silence a target locus.

The methods of the present disclosure for silencing target loci in host cells may also involve the introduction of small interfering RNAs (siRNAs) at a target locus in conjunction with Pol V targeting by one or more of a SUVH2 protein, a SUVH9 protein, a DMS3 protein, a MORC6 protein, a SUVR2 protein, a DRD1 protein, an RDM1 protein, a DRM3 protein, a DRM2 protein, and/or an FRG protein at that locus. Methods of generating siRNAs are well-known in the art. These methods include, for example, expression of hairpin RNAs that are naturally processed into small interfering RNAs in cells. Hairpin constructs that make small interfering RNAs are known in the art (EMBO Reports, 2006 November; 7(11):1168-75). Additional methods for generating siRNAs include, for example, the direct introduction of small interfering RNAs into a cell from exogenous sources. Methods describing bombardment of siRNAs into plants are known in the art (Science 328, 912 (2010)). RNA molecules may also be sprayed (exogenous application) onto a plant so that small RNAs can then be generated in a plant cell (See U.S. Patent Application 2014/0018241). Accordingly, the methods of the present disclosure for silencing target loci in host cells may also involve the introduction of small interfering RNAs (siRNAs) at a target locus in conjunction with Pol V targeting by one or more of a heterologous DNA-binding domain containing SUVH2 protein, SUVH9 protein, DMS3 protein, MORC6 protein, SUVR2 protein, DRD1 protein, RDM1 protein, DRM3 protein, DRM2 protein, and/or FRG protein at that locus.

Silencing induced by targeting various recombinant proteins of the present disclosure such as, for example, SHH1-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins, can be stable in plants even in the absence of these recombinant proteins. Accordingly, the methods of the present disclosure may allow one or more target nucleic acids in a plant to remain silenced after the recombinant polynucleotides of the present disclosure have been crossed out of the plant. For example, after targeting a particular region with siRNAs together with a recombinant protein of the present disclosure that recruits Pol V, the silencing and DNA methylation of the targeted region may remain stable even after crossing away the transgenes. It is an object of the present disclosure to provide plants having reduced expression of one or more target nucleic acids according to the methods of the present disclosure. As the methods of the present disclosure may allow one or more target nucleic acids in a plant to remain silenced after the recombinant polynucleotides of the present disclosure have been crossed out of the plant, the progeny plants of these plants may have reduced expression of one or more target nucleic acids even in the absence of the recombinant polynucleotides that produce the recombinant polypeptides of the present disclosure.

Definitions

Unless defined otherwise, all scientific and technical terms are understood to have the same meaning as commonly used in the art to which they pertain. For the purpose of the present disclosure, the following terms are defined.

As used herein, a "target nucleic acid" refers to a portion of double-stranded polynucleotide acid, e.g., RNA, DNA, PNA (peptide nucleic acid) or combinations thereof, to which it is advantageous to bind a protein. In one embodiment, a "target nucleic acid" is all or part of a transcriptional control element for a gene for which a desired phenotypic result can be attained by altering the degree of its expression. A transcriptional control element includes positive and negative control elements such as a promoter, an enhancer, other response elements, e.g., steroid response element, heat shock response element, metal response element, a repressor binding site, operator, and/or a silencer. The transcriptional control element can be viral, eukaryotic, or prokaryotic. A "target nucleic acid" also includes all or a portion of the coding region or a protein-coding gene. A "target nucleic acid" also includes a downstream nucleic acid that can bind a protein and whose expression is thereby modulated, typically preventing transcription.

As used herein, a "target gene" refers to a gene whose expression is to be reduced by a protein, such as, for example, an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein.

As used herein, the terms "polynucleotide", "nucleic acid", "nucleic acid sequence", "sequence of nucleic acids", and variations thereof shall be generic to polydeoxyribonucleotides (containing 2-deoxy-D-ribose), to polyribonucleotides (containing D-ribose), to any other type of polynucleotide that is an N-glycoside of a purine or pyrimidine base, and to other polymers containing non-nucleotidic backbones, provided that the polymers contain nucleobases in a configuration that allows for base pairing and base stacking, as found in DNA and RNA. Thus, these terms include known types of nucleic acid sequence modifications, for example, substitution of one or more of the naturally occurring nucleotides with an analog; inter-nucleotide modifications, such as, for example, those with uncharged linkages (e.g., methyl phosphonates, phosphotriesters, phosphoramidates, carbamates, etc.), with negatively charged linkages (e.g., phosphorothioates, phosphorodithioates, etc.), and with positively charged linkages (e.g., aminoalkylphosphoramidates, aminoalkylphosphotriesters); those containing pendant moieties, such as, for example, proteins (including nucleases, toxins, antibodies, signal peptides, poly-L-lysine, etc.); those with intercalators (e.g., acridine, psoralen, etc.); and those containing chelators (e.g., metals, radioactive metals, boron, oxidative metals, etc.). As used herein, the symbols for nucleotides and polynucleotides are those recommended by the IUPAC-IUB Commission of Biochemical Nomenclature (Biochem. 9:4022, 1970).

As used herein, a "polypeptide" is an amino acid sequence containing a plurality of consecutive polymerized amino acid residues (e.g., optionally at least about 15 consecutive polymerized amino acid residues, at least about 30 consecutive polymerized amino acid residues, or at least about 50 consecutive polymerized amino acid residues). In many instances, a polypeptide contains a polymerized amino acid residue sequence that is an enzyme, a methyltransferase, a demethylase, a deacteylase, a predicted protein of unknown function, or a domain or portion or fragment thereof. The polypeptide optionally contains modified amino acid residues, naturally occurring amino acid residues not encoded by a codon, and non-naturally occurring amino acid residues.

As used herein, "protein" refers to an amino acid sequence, oligopeptide, peptide, polypeptide, or portions thereof whether naturally occurring or synthetic.

Genes and proteins that may be used in the present disclosure include genes encoding conservatively modified variants and proteins that are conservatively modified variants of those genes and proteins described throughout the application. "Conservatively modified variants" as used herein include individual substitutions, deletions or additions to a polypeptide sequence which result in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the disclosure. The following eight groups contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)).

Homologs of the genes and proteins described herein may also be used in the present disclosure. As used herein, "homology" refers to sequence similarity between a reference sequence and at least a fragment of a second sequence. Homologs may be identified by any method known in the art, preferably, by using the BLAST tool to compare a reference sequence to a single second sequence or fragment of a sequence or to a database of sequences. As described below, BLAST will compare sequences based upon percent identity and similarity. As used herein, "orthology" refers to genes in different species that derive from a common ancestor gene.

The terms "identical" or percent "identity," in the context of two or more nucleic acids or polypeptide sequences, refer to two or more sequences or subsequences that are the same. Two sequences are "substantially identical" if two sequences have a specified percentage of amino acid residues or nucleotides that are the same (i.e., 29% identity, optionally 30%, 40%, 45%, 50%, 55%, 60%, 65%, 70%, 75%, 80%, 85%, 90%, 95%, 99% or 100% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200, or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. When comparing two sequences for identity, it is not necessary that the sequences be contiguous, but any gap would carry with it a penalty that would reduce the overall percent identity. For blastn, the default parameters are Gap opening penalty=5 and Gap extension penalty=2. For blastp, the default parameters are Gap opening penalty=11 and Gap extension penalty=1.

A "comparison window," as used herein, includes reference to a segment of any one of the number of contiguous positions including, but not limited to from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well known in the art. Optimal alignment of sequences for comparison can be conducted, e.g., by the local homology algorithm of Smith and Waterman (1981), by the homology alignment algorithm of Needleman and Wunsch (1970) *J Mol Biol* 48(3):443-453, by the search for similarity method of Pearson and Lipman (1988) *Proc Natl Acad Sci USA* 85(8):2444-2448, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection [see, e.g., Brent et al., (2003) Current Protocols in Molecular Biology, John Wiley & Sons, Inc. (Ringbou Ed)].

Two examples of algorithms that are suitable for determining percent sequence identity and sequence similarity are the BLAST and BLAST 2.0 algorithms, which are described in Altschul et al. (1997) Nucleic Acids Res 25(17): 3389-3402 and Altschul et al. (1990) J. Mol Biol 215(3)- 403-410, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always>0) and N (penalty score for mismatching residues; always<0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4, and a comparison of both strands. For amino acid sequences, the BLASTP program uses as defaults a wordlength of 3, and expectation (E) of 10, and the BLOSUM62 scoring matrix (see Henikoff and Henikoff, (1992) Proc Natl Acad Sci USA 89(22): 10915-10919) alignments (B) of 50, expectation (E) of 10, M=5, N=−4, and a comparison of both strands.

The BLAST algorithm also performs a statistical analysis of the similarity between two sequences (see, e.g., Karlin and Altschul, (1993) Proc Natl Acad Sci USA 90(12):5873-5877). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

Other than percentage of sequence identity noted above, another indication that two nucleic acid sequences or polypeptides are substantially identical is that the polypeptide encoded by the first nucleic acid is immunologically cross-reactive with the antibodies raised against the polypeptide encoded by the second nucleic acid. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions. Yet another indication that two nucleic acid sequences are substantially identical is that the same primers can be used to amplify the sequence.

Recombinant Proteins of the Present Disclosure

Provided herein are recombinant proteins for use in reducing the expression of a target nucleic acid in a plant. In some embodiments, a recombinant protein of the present disclosure interacts with an RNA polymerase. This interaction may be direct or it may be indirect. Whether the interaction of a recombinant protein of the present disclosure with an RNA polymerase is direct or indirect, the interaction facilitates the recruitment of the RNA polymerase to a nucleic acid. In some embodiments, one or more additional proteins may be further involved in facilitating the interaction of a recombinant protein of the present disclosure with an RNA polymerase and recruitment of the RNA polymerase to a nucleic acid. In some embodiments, an SHH1-like protein interacts, directly or indirectly, with RNA Pol IV and this interaction facilitates the recruitment of RNA Pol IV to a nucleic acid. In some embodiments, a SUVH2-like protein and/or a SUVH9-like protein interacts, directly or indirectly, with RNA Pol V and this interaction facilitates the recruitment of RNA Pol V to a nucleic acid. In some embodiments, DMS3-like proteins, MORC6-like proteins, and/or SUVR2-like proteins interact, directly or indirectly, with RNA Pol V and this interaction facilitates the recruitment of RNA Pol V to a nucleic acid. In some embodiments, DMS3-like proteins, MORC6-like proteins, SUVR2-like proteins, DRD1-like proteins, RDM1 like proteins, DRM3-like proteins, DRM2-like proteins, and/or FRG-like proteins, interact, directly or indirectly, with RNA Pol V and this interaction facilitates the recruitment of RNA Pol V to a nucleic acid. In some embodiments, the recombinant proteins of the present disclosure facilitate RNA-directed DNA methylation of a nucleic acid.

In some embodiments, SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins are targeted to the same nucleic acid and cooperatively act to silence the expression of the target nucleic acid. Recombinant proteins of the present disclosure, for example SHH1-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins may be recombinantly expressed in a cell either alone or in combinations.

SHH1 Proteins

Certain aspects of the present disclosure relate to SHH1-like proteins. In some embodiments, an SHH1-like protein refers to a recombinant SHH1 protein or fragment thereof and that contains a heterologous DNA-binding domain. SHH1-like proteins may be used in reducing the expression of one or more target nucleic acids, such as genes, in plants.

SHH1 proteins of the present disclosure are SAWADEE HOMEODOMAIN HOMOLOG 1 (SHH1) proteins. Full-length SHH1 proteins contain a chromatin-binding SAWADEE domain. The SAWADEE chromatin-binding domain adopts a unique tandem Tudor-like fold and functions as a dual lysine reader, probing for both unmethylated K4 and methylated K9 modifications on the histone 3 (H3) tail. SHH1 proteins also contain a homeodomain. In some embodiments, SHH1-like proteins of the present disclosure are chromatin-binding proteins.

In some embodiments, an SHH1-like protein of the present disclosure includes a functional fragment of a full-length SHH1 protein where the fragment maintains the ability to recruit RNA Pol IV to DNA. In some embodiments, an SHH1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length SHH1 protein. In some embodiments, SHH1 protein fragments may include sequences with one or more amino acids removed from the consecutive amino acid sequence of a full-length SHH1 protein. In some embodiments, SHH1 protein fragments may include sequences with one or more amino acids replaced/substituted with an amino acid different from the endogenous amino acid present at a given amino acid position in a consecutive amino acid sequence of a full-length SHH1 protein. In some embodiments, SHH1 protein fragments may include sequences with one or more amino acids added to an otherwise consecutive amino acid sequence of a full-length SHH1 protein.

Suitable SHH1 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable SHH1 proteins may include, for example, those listed in Table 1, homologs thereof, and orthologs thereof.

TABLE 1

SHH1 Proteins

| Organism | Gene Name | SED ID NO. |
|---|---|---|
| *Arabidopsis thaliana* | NP_849666.2 | 1 |
| *Ricinus communis* | XP_002515974.1 | 2 |
| *Glycine max* | XP_003531650.1 | 3 |
| *Zea mays* | NP_001141052.1 | 4 |
| *Medicago truncatula* | AFK39040.1 | 5 |
| *Physcomitrella patens* | XP_001760710.1 | 6 |
| *Sorghum bicolor* | XP_002462170.1 | 7 |
| *Oryza sativa* | NP_001062942.1 | 8 |
| *Brachypodium distachyon* | XP_003563870.1 | 9 |
| *Populus trichocarpa* | XP_002299736.1 | 10 |
| *Vitis vinifera* | XP_002283948.1 | 11 |
| *Cucumis sativus* | XP_004155951.1 | 12 |
| *Arabidopsis lyrata* | XP_002890094.1 | 13 |
| *Arabidopsis thaliana* | AEE76089 | 40 |

In some embodiments, an SHH1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SHH1 protein (i.e., SEQ ID NO: 1).

In some embodiments, the homolog of an SHH1 protein, or the homolog of a fragment of an SHH1 protein, is the amino acid sequence of the *Arabidopsis thaliana* SHH2 protein (SEQ ID NO: 40).

An SHH1-like protein may include the amino acid sequence or a fragment thereof of any SHH1 homolog or ortholog, such as any one of those listed in Table 1. One of skill would readily recognize that additional SHH1 homologs and/or orthologs may exist and may be used herein.

SUVH2 Proteins and SUVH9 Proteins

Certain aspects of the present disclosure relate to SUVH2-like proteins and SUVH9-like proteins. In some embodiments, a SUVH2-like protein refers to a recombinant SUVH2 protein or fragment thereof and that contains a heterologous DNA-binding domain. In some embodiments, a SUVH9-like protein refers to a recombinant SUVH9 protein or fragment thereof and that contains a heterologous DNA-binding domain. SUVH2-like proteins and/or SUVH9-like proteins may be used in reducing the expression of one or more target nucleic acids, such as genes, in plants.

SUVH2 and SUVH9 proteins of the present disclosure are SU-VAR(3-9) Homologs. Full-length SUVH2 and SUVH9 proteins contain a two-helix bundle domain towards the N-terminus, a SRA domain, and the pre-SET and SET domains towards the C-terminus. The structural and sequence features of the SUVH domains are known in the art and are provided herein. In some embodiments, SUVH2-like proteins and/or SUVH9-like proteins of the present disclosure may contain one or more of the canonical SUVH domains including a two-helix bundle domain, a SRA domain, a pre-SET domain, and/or a SET domain.

In some embodiments, a SUVH2-like protein of the present disclosure includes a functional fragment of a full-length SUVH2 protein where the fragment maintains the ability to recruit RNA Pol V to DNA. In some embodiments, a SUVH2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, at least 260 consecutive amino acids, at least 280 consecutive amino acids, at least 300 consecutive amino acids, at least 325 consecutive amino acids, at least 350 consecutive amino acids, at least 375 consecutive amino acids, at least 400 consecutive amino acids, at least 425 consecutive amino acids, at least 450 consecutive amino acids, at least 475 consecutive amino acids, at least 500 consecutive amino acids, at least 525 consecutive amino acids, at least 550 consecutive amino acids, at least 575 consecutive amino acids, at least 600 consecutive amino acids, at least 625 consecutive amino acids, or 626 or more consecutive amino acids of a full-length SUVH2 protein. In some embodiments, SUVH2 protein fragments may include sequences with one or more amino acids removed from the consecutive amino acid sequence of a full-length SUVH2 protein. In some embodiments, SUVH2 protein fragments may include sequences with one or more amino acids replaced/substituted with an amino acid different from the endogenous amino acid present at a given amino acid position in a consecutive amino acid sequence of a full-length SUVH2 protein. In some embodiments, SUVH2 protein fragments may include sequences with one or more amino acids added to an otherwise consecutive amino acid sequence of a full-length SUVH2 protein.

Suitable SUVH2 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable SUVH2 proteins may include, for example, those listed in Table 2, homologs thereof, and orthologs thereof.

TABLE 2

SUVH2 Proteins

| Organism | Gene Name | SEQ ID NO. |
|---|---|---|
| *Arabidopsis thaliana* | NP_180887.1 | 14 |
| *Ricinus communis* | XP_002528332.1 | 15 |
| *Glycine max* | XP_003530311.1 | 16 |
| *Zea mays* | DAA60407.1 | 17 |
| *Medicago truncatula* | XP_003619209.1 | 18 |
| *Physcomitrella patens* | XP_001753516.1 | 19 |
| *Sorghum bicolor* | XP_002459773.1 | 20 |
| *Oryza sativa* | EAZ03669.1 | 21 |
| *Brachypodium distachyon* | XP_003563196.1 | 22 |
| *Populus trichocarpa* | XP_002315593.1 | 23 |

TABLE 2-continued

SUVH2 Proteins

| Organism | Gene Name | SEQ ID NO. |
|---|---|---|
| Vitis vinifera | XP_002282386.1 | 24 |
| Cucumis sativus | XP_004134031.1 | 25 |
| Arabidopsis lyrata | XP_002879445.1 | 26 |

In some embodiments, a SUVH2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SUVH2 protein (i.e., SEQ ID NO: 14).

A SUVH2-like protein may include the amino acid sequence or a fragment thereof of any SUVH2 homolog or ortholog, such as any one of those listed in Table 2. One of skill would readily recognize that additional SUVH2 homologs and/or orthologs may exist and may be used herein.

In some embodiments, a SUVH9-like protein of the present disclosure includes a functional fragment of a full-length SUVH9 protein where the fragment maintains the ability to recruit RNA Pol V to DNA. In some embodiments, a SUVH9 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, at least 260 consecutive amino acids, at least 280 consecutive amino acids, at least 300 consecutive amino acids, at least 325 consecutive amino acids, at least 350 consecutive amino acids, at least 375 consecutive amino acids, at least 400 consecutive amino acids, at least 425 consecutive amino acids, at least 450 consecutive amino acids, at least 475 consecutive amino acids, at least 500 consecutive amino acids, at least 525 consecutive amino acids, at least 550 consecutive amino acids, at least 575 consecutive amino acids, at least 600 consecutive amino acids, at least 625 consecutive amino acids, or 626 or more consecutive amino acids of a full-length SUVH9 protein. In some embodiments, SUVH9 protein fragments may include sequences with one or more amino acids removed from the consecutive amino acid sequence of a full-length SUVH9 protein. In some embodiments, SUVH9 protein fragments may include sequences with one or more amino acids replaced/substituted with an amino acid different from the endogenous amino acid present at a given amino acid position in a consecutive amino acid sequence of a full-length SUVH9 protein. In some embodiments, SUVH9 protein fragments may include sequences with one or more amino acids added to an otherwise consecutive amino acid sequence of a full-length SUVH9 protein.

Suitable SUVH9 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor,* and *Oryza sativa*. Examples of suitable SUVH9 proteins may include, for example, those listed in Table 3, homologs thereof, and orthologs thereof.

TABLE 3

SUVH9 Proteins

| Organism | Gene Name | SEQ ID NO: |
|---|---|---|
| Arabidopsis thaliana | AF344452.1 | 27 |
| Ricinus communis | XP_002528332.1 | 28 |
| Glycine max | XP_003530311.1 | 29 |
| Zea mays | DAA60407.1 | 30 |
| Medicago truncatula | XP_003619209.1 | 31 |
| Physcomitrella patens | XP_001753516.1 | 32 |
| Sorghum bicolor | XP_002459773.1 | 33 |
| Oryza sativa | EAZ03669.1 | 34 |
| Brachypodium distachyon | XP_003563196.1 | 35 |
| Populus trichocarpa | XP_002315593.1 | 36 |
| Vitis vinifera | XP_002282386.1 | 37 |
| Cucumis sativus | XP_004134031.1 | 38 |
| Arabidopsis lyrata | XP_002863127.1 | 39 |

In some embodiments, a SUVH9 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SUVH9 protein (i.e., SEQ ID NO: 27).

A SUVH9-like protein may include the amino acid sequence or a fragment thereof of any SUVH9 homolog or ortholog, such as any one of those listed in Table 3. One of skill would readily recognize that additional SUVH9 homologs and/or orthologs may exist and may be used herein.

DMS3 Proteins

Certain aspects of the present disclosure relate to DMS3-like proteins. In some embodiments, a DMS3-like protein refers to a recombinant DMS3 protein or fragment thereof and that contains a heterologous DNA-binding domain. DMS3-like proteins may be used in reducing the expression of one or more target nucleic acids, such as genes, in plants.

DMS3 proteins are known in the art and are described herein. In some embodiments, a DMS3-like protein of the present disclosure includes a functional fragment of a full-length DMS3 protein where the fragment maintains one or more functions of the full-length protein. In some embodiments, a DMS3 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DMS3 protein. In some embodiments, DMS3 protein fragments may include sequences with one or more amino acids removed from the consecutive amino acid sequence of a full-length DMS3 protein. In some embodiments, DMS3 protein fragments may include sequences with one or more amino acids replaced/substituted with an amino acid different from the endogenous amino acid present at a given amino acid position in a consecutive amino acid sequence of a full-length DMS3 protein. In some embodiments, DMS3 protein fragments may include sequences with one or more amino acids added to an otherwise consecutive amino acid sequence of a full-length DMS3 protein.

Suitable DMS3 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable DMS3 proteins may include, for example, those listed in Table 4, homologs thereof, and orthologs thereof.

TABLE 4

DMS3 Proteins

| Organism | Gene Name | SEQ ID NO: |
|---|---|---|
| *Arabidopsis thaliana* | DMS3 | 41 |
| *Solanum lycopersicum* | XP_004234924.1 | 42 |
| *Solanum tuberosum* | XP_006350630.1 | 43 |
| *Phaseolus vulgaris* | ESW19314.1 | 44 |
| *Vitis vinifera* | XP_002277586.1 | 45 |
| *Theobroma cacao* | EOY23566.1 | 46 |
| *Glycine max* | XP_003550866.1 | 47 |
| *Oriza sativa Japonica* group | NP_001042520.1 | 48 |
| *Oriza sativa Indica* group | EEC70256.1 | 49 |
| *Zea mays* | NP_001132336.1 | 50 |
| *Sorghum bicolor* | XP_002454876.1 | 51 |

In some embodiments, a DMS3 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* DMS3 protein (i.e., SEQ ID NO: 41).

In some embodiments, the homolog of a DMS3 protein, or the homolog of a fragment of a DMS3 protein, may also be used in the methods of the present disclosure.

A DMS3-like protein may include the amino acid sequence or a fragment thereof of any DMS3 homolog or ortholog, such as, for example, any one of those listed in Table 4. One of skill would readily recognize that additional DMS3 homologs and/or orthologs may exist and may be used herein.

MORC6 Proteins

Certain aspects of the present disclosure relate to MORC6-like proteins. In some embodiments, a MORC6-like protein refers to a recombinant MORC6 protein or fragment thereof and that contains a heterologous DNA-binding domain. MORC6-like proteins may be used in reducing the expression of one or more target nucleic acids, such as genes, in plants.

MORC6 proteins are known in the art and are described herein. In some embodiments, a MORC6-like protein of the present disclosure includes a functional fragment of a full-length MORC6 protein where the fragment maintains one or more functions of the full-length protein. In some embodiments, a MORC6 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length MORC6 protein. In some embodiments, MORC6 protein fragments may include sequences with one or more amino acids removed from the consecutive amino acid sequence of a full-length MORC6 protein. In some embodiments, MORC6 protein fragments may include sequences with one or more amino acids replaced/substituted with an amino acid different from the endogenous amino acid present at a given amino acid position in a consecutive amino acid sequence of a full-length MORC6 protein. In some embodiments, MORC6 protein fragments may include sequences with one or more amino acids added to an otherwise consecutive amino acid sequence of a full-length MORC6 protein.

Suitable MORC6 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable MORC6 proteins may include, for example, those listed in Table 5, homologs thereof, and orthologs thereof.

TABLE 5

MORC6 Proteins

| Organism | Gene Name | SEQ ID NO: |
|---|---|---|
| *Arabidopsis thaliana* | MORC6 | 53 |
| *Solanum lycopersicum* | XP_004230214.1 | 54 |
| *Solanum tuberosum* | XP_006344837.1 | 55 |
| *Phaseolus vulgaris* | ESW10038.1 | 56 |
| *Vitis vinifera* | XP_002278685.1 | 57 |
| *Theobroma cacao* | EOY20772.1 | 58 |
| *Triticum urarte* | EMS64080.1 | 59 |
| *Glycine max* | XP_003523086.1 | 60 |
| *Oriza sativa Japonica* group | EEE54777.1 | 61 |
| *Oriza sativa Indica* group | EEC70857.1 | 62 |
| *Zea mays* | AFW84846.1 | 63 |
| *Sorghum bicolor* | XP_002455787.1 | 64 |

In some embodiments, a MORC6 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* MORC6 protein (i.e., SEQ ID NO: 53).

In some embodiments, the homolog of a MORC6 protein, or the homolog of a fragment of a MORC6 protein, may also be used in the methods of the present disclosure.

A MORC6-like protein may include the amino acid sequence or a fragment thereof of any MORC6 homolog or ortholog, such as, for example, any one of those listed in Table 5. One of skill would readily recognize that additional MORC6 homologs and/or orthologs may exist and may be used herein.

SUVR2 Proteins

Certain aspects of the present disclosure relate to SUVR2-like proteins. In some embodiments, a SUVR2-like protein refers to a recombinant SUVR2 protein or fragment thereof and that contains a heterologous DNA-binding domain. SUVR2-like proteins may be used in reducing the expression of one or more target nucleic acids, such as genes, in plants.

SUVR2 proteins are known in the art and are described herein. In some embodiments, a SUVR2-like protein of the present disclosure includes a functional fragment of a full-length SUVR2 protein where the fragment maintains one or more functions of the full-length protein. In some embodiments, a SUVR2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length SUVR2 protein. In some embodiments, SUVR2 protein fragments may include sequences with one or more amino acids removed from the consecutive amino acid sequence of a full-length SUVR2 protein. In some embodiments, SUVR2 protein fragments may include sequences with one or more amino acids replaced/substituted with an amino acid different from the endogenous amino acid present at a given amino acid position in a consecutive amino acid sequence of a full-length SUVR2 protein. In some embodiments, SUVR2 protein fragments may include sequences with one or more amino acids added to an otherwise consecutive amino acid sequence of a full-length SUVR2 protein.

Suitable SUVR2 proteins may be identified and isolated from monocot and dicot plants. Examples of such plants may include, for example, *Arabidopsis* spp., *Ricinus communis*, *Glycine max*, *Zea Mays*, *Medicago truncatula*, *Physcomitrella patens*, *Sorghum bicolor*, and *Oryza sativa*. Examples of suitable SUVR2 proteins may include, for example, those listed in Table 6, homologs thereof, and orthologs thereof.

TABLE 6

SUVR2 Proteins

| Organism | Gene Name | SEQ ID NO: |
|---|---|---|
| *Arabidopsis thaliana* | SUVR2 | 66 |
| *Solanum lycopersicum* | XP_004247936.1 | 67 |
| *Solanum tuberosum* | XP_006358446.1 | 68 |
| *Phaseolus vulgaris* | ESW16847.1 | 69 |
| *Vitis vinifera* | XP_002270320.2 | 70 |
| *Theobroma cacao* | EOX94338.1 | 71 |

TABLE 6-continued

SUVR2 Proteins

| Organism | Gene Name | SEQ ID NO: |
|---|---|---|
| *Triticum urarte* | EMS67506.1 | 72 |
| *Glycine max* | XP_003541369.1 | 73 |
| *Oriza sativa Japonica* group | NP_001047458.1 | 74 |
| *Oriza sativa Indica* group | EEC78330.1 | 75 |
| *Zea mays* | DAA48520.1 | 76 |
| *Sorghum bicolor* | XP_002445655.1 | 77 |

In some embodiments, a SUVR2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SUVR2 protein (i.e., SEQ ID NO: 66).

In some embodiments, the homolog of a SUVR2 protein, or the homolog of a fragment of a SUVR2 protein, may also be used in the methods of the present disclosure.

A SUVR2-like protein may include the amino acid sequence or a fragment thereof of any SUVR2 homolog or ortholog, such as, for example, any one of those listed in Table 6. One of skill would readily recognize that additional SUVR2 homologs and/or orthologs may exist and may be used herein.

DRD1 Proteins

Certain aspects of the present disclosure relate to DRD1-like proteins. In some embodiments, a DRD1-like protein refers to a recombinant DRD1 protein or fragment thereof and that contains a heterologous DNA-binding domain. DRD1-like proteins may be used in reducing the expression of one or more target nucleic acids, such as genes, in plants.

DRD1 proteins are known in the art and are described herein. In some embodiments, a DRD1-like protein of the present disclosure includes a functional fragment of a full-length DRD1 protein where the fragment maintains one or more functions of the full-length protein. In some embodiments, a DRD1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DRD1 protein. In some embodiments, DRD1 protein fragments may include sequences with one or more amino acids removed from the consecutive amino acid sequence of a full-length DRD1 protein. In some embodiments, DRD1 protein fragments may include sequences with one or more amino acids replaced/substituted with an amino acid different from the endogenous amino acid present at a given amino acid position in a consecutive amino acid sequence of a full-length DRD1 protein. In some embodiments, DRD1 protein fragments may include sequences with one or more amino acids added to an otherwise consecutive amino acid sequence of a full-length DRD1 protein.

Suitable DRD1 proteins may be identified and isolated from monocot and dicot plants. Examples of such plants may include, for example, *Arabidopsis* spp., *Ricinus communis*, *Glycine max*, *Zea Mays*, *Physcomitrella patens*, *Sorghum bicolor*, and *Oryza sativa*. Examples of suitable DRD1 proteins may include, for example, those listed in Table 7, homologs thereof, and orthologs thereof.

TABLE 7

DRD1 Proteins

| Organism | Gene Name | SEQ ID NO: |
|---|---|---|
| *Arabidopsis thaliana* | NP_179232.1 | 79 |
| *Ricinus communis* | XP_002530324.1 | 80 |
| *Glycine max* | XP_003540522.1 | 81 |
| *Zea mays* | AFW57413.1 | 82 |
| *Physcomitrella patens* | XP_001752976.1 | 83 |
| *Sorghum bicolor* | XP_002445019.1 | 84 |
| *Oryza sativa* | BAC84084.1 | 85 |
| *Brachypodium distachyon* | XP_003571619.1 | 86 |
| *Populus trichocarpa* | XP_002313774.2 | 87 |
| *Vitis vinifera* | XP_002273814.1 | 88 |
| *Cucumis sativus* | XP_004170971.1 | 89 |
| *Arabidopsis lyrata* | XP_002884170.1 | 90 |

In some embodiments, a DRD1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* DRD1 protein (i.e., SEQ ID NO: 79).

In some embodiments, the homolog of a DRD1 protein, or the homolog of a fragment of a DRD1 protein, may also be used in the methods of the present disclosure.

A DRD1-like protein may include the amino acid sequence or a fragment thereof of any DRD1 homolog or ortholog, such as, for example, any one of those listed in Table 7. One of skill would readily recognize that additional DRD1 homologs and/or orthologs may exist and may be used herein.

RDM1 Proteins

Certain aspects of the present disclosure relate to RDM1-like proteins. In some embodiments, a RDM1-like protein refers to a recombinant RDM1 protein or fragment thereof and that contains a heterologous DNA-binding domain. RDM1-like proteins may be used in reducing the expression of one or more target nucleic acids, such as genes, in plants.

RDM1 proteins are known in the art and are described herein. In some embodiments, a RDM1-like protein of the present disclosure includes a functional fragment of a full-length RDM1 protein where the fragment maintains one or more functions of the full-length protein. In some embodiments, a RDM1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length RDM1 protein. In some embodiments, RDM1 protein fragments may include sequences with one or more amino acids removed from the consecutive amino acid sequence of a full-length RDM1 protein. In some embodiments, RDM1 protein fragments may include sequences with one or more amino acids replaced/substituted with an amino acid different from the endogenous amino acid present at a given amino acid position in a consecutive amino acid sequence of a full-length RDM1 protein. In some embodiments, RDM1 protein fragments may include sequences with one or more amino acids added to an otherwise consecutive amino acid sequence of a full-length RDM1 protein.

Suitable RDM1 proteins may be identified and isolated from monocot and dicot plants. Examples of such plants may include, for example, *Arabidopsis* spp., *Ricinus communis*, *Glycine max*, *Zea Mays*, and *Oryza sativa*. Examples of suitable RDM1 proteins may include, for example, those listed in Table 8, homologs thereof, and orthologs thereof.

TABLE 8

RDM1 Proteins

| Organism | Gene Name | SEQ ID NO: |
|---|---|---|
| *Arabidopsis thaliana* | NP_188907.2 | 91 |
| *Ricinus communis* | XP_002517093.1 | 92 |
| *Glycine max* | NP_001237231.1 | 93 |
| *Zea mays* | NP_001170520.1 | 94 |
| *Medicago truncatula* | XP_003610752.1 | 95 |
| *Oryza sativa* | BAD38576.1 | 96 |
| *Populus trichocarpa* | XP_002311634.1 | 97 |
| *Vitis vinifera* | XP_002279112.2 | 98 |
| *Cucumis sativus* | XP_004134127.1 | 99 |
| *Arabidopsis lyrata* | XP_002883375.1 | 100 |

In some embodiments, a RDM1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* RDM1 protein (i.e., SEQ ID NO: 91).

In some embodiments, the homolog of a RDM1 protein, or the homolog of a fragment of a RDM1 protein, may also be used in the methods of the present disclosure.

A RDM1-like protein may include the amino acid sequence or a fragment thereof of any RDM1 homolog or ortholog, such as, for example, any one of those listed in Table 8. One of skill would readily recognize that additional RDM1 homologs and/or orthologs may exist and may be used herein.

DRM3 Proteins

Certain aspects of the present disclosure relate to DRM3-like proteins. In some embodiments, a DRM3-like protein refers to a recombinant DRM3 protein or fragment thereof and that contains a heterologous DNA-binding domain. DRM3-like proteins may be used in reducing the expression of one or more target nucleic acids, such as genes, in plants.

DRM3 proteins are known in the art and are described herein. In some embodiments, a DRM3-like protein of the present disclosure includes a functional fragment of a full-length DRM3 protein where the fragment maintains one or more functions of the full-length protein. In some embodiments, a DRM3 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DRM3 protein. In some embodiments, DRM3 protein fragments may include sequences with one or more amino acids removed from the consecutive amino acid sequence of a full-length DRM3 protein. In some embodiments, DRM3 protein fragments may include sequences with one or more amino acids replaced/substituted with an amino acid different from the endogenous amino acid present at a given amino acid position in a consecutive amino acid sequence of a full-length DRM3 protein. In some embodiments, DRM3 protein fragments may include sequences with one or more amino acids added to an otherwise consecutive amino acid sequence of a full-length DRM3 protein.

Suitable DRM3 proteins may be identified and isolated from monocot and dicot plants. Examples of such plants may include, for example, *Arabidopsis* spp., *Ricinus communis, Glycine max, Zea Mays, Physcomitrella patens, Sorghum bicolor*, and *Oryza sativa*. Examples of suitable DRM3 proteins may include, for example, those listed in Table 9, homologs thereof, and orthologs thereof.

TABLE 9

DRM3 Proteins

| Organism | Gene Name | SEQ ID NO: |
|---|---|---|
| *Arabidopsis thaliana* | NP_566573.1 | 101 |
| *Ricinus communis* | XP_002519294.1 | 102 |
| *Glycine max* | XP_006583974.1 | 103 |
| *Zea mays* | NP_001105094.1 | 104 |
| *Medicago truncatula* | XP_003609841.1 | 105 |
| *Sorghum bicolor* | XP_002468285.1 | 106 |
| *Oryza sativa* | AAT85176.1 | 107 |
| *Brachypodium distachyon* | XP_003569077.1 | 108 |
| *Populus trichocarpa* | XP_002316067.2 | 109 |
| *Vitis vinifera* | XP_002264226.1 | 110 |
| *Cucumis sativus* | XP_004138523.1 | 111 |
| *Arabidopsis lyrata* | XP_002885200.1 | 112 |

In some embodiments, a DRM3 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* DRM3 protein (i.e., SEQ ID NO: 101).

In some embodiments, the homolog of a DRM3 protein, or the homolog of a fragment of a DRM3 protein, may also be used in the methods of the present disclosure.

A DRM3-like protein may include the amino acid sequence or a fragment thereof of any DRM3 homolog or ortholog, such as, for example, any one of those listed in Table 9. One of skill would readily recognize that additional DRM3 homologs and/or orthologs may exist and may be used herein.

DRM2 Proteins

Certain aspects of the present disclosure relate to DRM2-like proteins. In some embodiments, a DRM2-like protein refers to a recombinant DRM2 protein or fragment thereof and that contains a heterologous DNA-binding domain. DRM2-like proteins may be used in reducing the expression of one or more target nucleic acids, such as genes, in plants.

DRM2 proteins are known in the art and are described herein. In some embodiments, a DRM2-like protein of the present disclosure includes a functional fragment of a full-length DRM2 protein where the fragment maintains one or more functions of the full-length protein. In some embodiments, a DRM2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DRM2 protein. In some embodiments, DRM2 protein fragments may include sequences with one or more amino acids removed from the consecutive amino acid sequence of a full-length DRM2 protein. In some embodiments, DRM2 protein fragments may include sequences with one or more amino acids replaced/substituted with an amino acid different from the endogenous amino acid present at a given amino acid position in a consecutive amino acid sequence of a full-length DRM2 protein. In some embodiments, DRM2 protein fragments may include sequences with one or more amino acids added to an otherwise consecutive amino acid sequence of a full-length DRM2 protein.

Suitable DRM2 proteins may be identified and isolated from monocot and dicot plants. Examples of such plants may include, for example, *Arabidopsis* spp., *Ricinus communis, Glycine max, Zea Mays, Physcomitrella patens, Sorghum bicolor*, and *Oryza sativa*. Examples of suitable DRM2 proteins may include, for example, those listed in Table 10, homologs thereof, and orthologs thereof.

TABLE 10

DRM2 Proteins

| Organism | Gene Name | SEQ ID NO: |
|---|---|---|
| *Arabidopsis thaliana* | XP_196966.2 | 113 |
| *Ricinus communis* | XP_002521449.1 | 114 |
| *Glycine max* | XP_003524549.1 | 115 |
| *Zea mays* | NP_001104977.1 | 116 |
| *Medicago truncatula* | XP_003618189.1 | 117 |
| *Sorghum bicolor* | XP_002468660.1 | 118 |
| *Oryza sativa* | ABF93591.1 | 119 |
| *Brachypodium distachyon* | XP_003575456.1 | 120 |
| *Populus trichocarpa* | XP_002300046.2 | 121 |
| *Vitis vinifera* | XP_002273972.2 | 122 |

TABLE 10-continued

DRM2 Proteins

| Organism | Gene Name | SEQ ID NO: |
|---|---|---|
| Cucumis sativus | XP_004141100.1 | 123 |
| Arabidopsis lyrata | XP_002873681.1 | 124 |

In some embodiments, a DRM2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* DRM2 protein (i.e., SEQ ID NO: 113).

In some embodiments, the homolog of a DRM2 protein, or the homolog of a fragment of a DRM2 protein, may also be used in the methods of the present disclosure.

A DRM2-like protein may include the amino acid sequence or a fragment thereof of any DRM2 homolog or ortholog, such as, for example, any one of those listed in Table 10. One of skill would readily recognize that additional DRM2 homologs and/or orthologs may exist and may be used herein.

FRG Proteins

Certain aspects of the present disclosure relate to FRG-like proteins. In some embodiments, a FRG-like protein refers to a recombinant FRG protein or fragment thereof and that contains a heterologous DNA-binding domain. FRG-like proteins may be used in reducing the expression of one or more target nucleic acids, such as genes, in plants.

FRG proteins are known in the art and are described herein. In some embodiments, a FRG-like protein of the present disclosure includes a functional fragment of a full-length FRG protein where the fragment maintains one or more functions of the full-length protein. In some embodiments, a FRG protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length FRG protein. In some embodiments, FRG protein fragments may include sequences with one or more amino acids removed from the consecutive amino acid sequence of a full-length FRG protein. In some embodiments, FRG protein fragments may include sequences with one or more amino acids replaced/substituted with an amino acid different from the endogenous amino acid present at a given amino acid position in a consecutive amino acid sequence of a full-length FRG protein. In some embodiments, FRG protein fragments may include sequences with one or more amino acids added to an otherwise consecutive amino acid sequence of a full-length FRG protein.

Suitable FRG proteins may be identified and isolated from monocot and dicot plants. Examples of such plants may include, for example, *Arabidopsis* spp., *Ricinus communis*, *Glycine max*, *Zea Mays*, *Physcomitrella patens*, *Sorghum bicolor*, and *Oryza sativa*. Examples of suitable FRG proteins may include, for example, those listed in Table 11, homologs thereof, and orthologs thereof.

TABLE 11

FRG Proteins

| Organism | Gene Name | SEQ ID NO: |
|---|---|---|
| Arabidopsis thaliana | NP_188635.1 | 125 |
| Ricinus communis | XP_002513133.1 | 126 |
| Glycine max | XP_003555190.1 | 127 |
| Zea mays | AFW61101.1 | 128 |
| Medicago truncatula | XP_003593498.1 | 129 |
| Physcomitrella patens | XP_001770987.1 | 130 |
| Sorghum bicolor | XP_002458594.1 | 131 |
| Oryza sativa | NP_001061138.1 | 132 |
| Brachypodium distachyon | XP_003560909.1 | 133 |
| Populus trichocarpa | XP_002305010.2 | 134 |
| Vitis vinifera | XP_002267403 | 135 |
| Cucumis sativus | XP_004134959 | 136 |
| Arabidopsis lyrata | XP_002883222.1 | 137 |

In some embodiments, a FRG protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* FRG protein (i.e., SEQ ID NO: 125).

In some embodiments, the homolog of a FRG protein, or the homolog of a fragment of a FRG protein, may also be used in the methods of the present disclosure.

A FRG-like protein may include the amino acid sequence or a fragment thereof of any FRG homolog or ortholog, such as, for example, any one of those listed in Table 11. One of skill would readily recognize that additional FRG homologs and/or orthologs may exist and may be used herein.

DNA-Binding Domains

SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins of the present disclosure have DNA-binding activity. This DNA-binding activity is achieved through a heterologous DNA-binding domain. In some embodiments, recombinant proteins of the present disclosure contain a DNA-binding domain. Recombinant proteins of the present disclosure may contain one DNA binding domain or they may contain more than one DNA-binding domain.

In some embodiments, the DNA-binding domain is a zinc finger domain. As disclosed herein, a "zinc finger domain" refers to a DNA-binding protein domain that contains zinc fingers, which are small protein structural motifs that can coordinate one or more zinc ions to help stabilize their protein folding. Zinc fingers can generally be classified into several different structural families and typically function as interaction modules that bind DNA, RNA, proteins, or small molecules. Suitable zinc finger domains of the present disclosure may contain two, three, four, five, six, seven, eight, or nine zinc fingers. Examples of suitable zinc finger domains may include, for example, Cys2His2 (C2H2) zinc finger domains, C-x8-C-x5-C-x3-H (CCCH) zinc finger domains, multi-cysteine zinc finger domains, and zinc binuclear cluster domains.

In some embodiments, the DNA-binding domain binds a specific nucleic acid sequence. For example, the DNA-binding domain may bind a sequence that is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 20 nucleotides, at least 25 nucleotides, at least 30 nucleotides, at least 35 nucleotides, at least 40 nucleotides, at least 45 nucleotides, at least 50 nucleotides, or a high number of nucleotides in length. In some embodiments, the DNA-binding domain binds a sequence that is 8 nucleotides in length.

In some embodiments, a recombinant protein of the present disclosure further contains two N-terminal CCCH zinc finger domains.

In some embodiments, the zinc finger domain is an engineered zinc finger array, such as a C2H2 zinc finger array. Engineered arrays of C2H2 zinc fingers can be used to create DNA-binding proteins capable of targeting desired genomic DNA sequences. Methods of engineering zinc finger arrays are well known in the art, and include, for example, combining smaller zinc fingers of known specificity.

In some embodiments, the recombinant protein may contain a DNA-binding domain other than a zinc finger domain. Examples of such DNA-binding domains may include, for example, TAL (transcription activator-like) effector targeting domains, helix-turn-helix family DNA-binding domains, basic domains, ribbon-helix-helix domains, TBP (TATA-box binding protein) domains, barrel dimer domains, RHB domains (real homology domain), BAH (bromo-adjacent homology) domains, SANT domains, Chromodomains, Tudor domains, Bromodomains, PHD domains (plant homeo domain), WD40 domains, and MBD domains (methyl-CpG-binding domain).

In some embodiments, the DNA-binding domain is a TAL effector targeting domain. As used herein, TAL effectors refer to secreted bacterial proteins, such as those secreted by *Xanthomonas* or *Ralstonia* bacteria when infecting various plant species. Generally, TAL effectors are capable of binding promoter sequences in the host plant, and activate the expression of plant genes that aid in bacterial infection. TAL effectors recognize plant DNA sequences through a central repeat targeting domain that contains a variable number of approximately 34 amino acid repeats. Moreover, TAL effector targeting domains can be engineered to target specific DNA sequences. Methods of modifying TAL effector targeting domains are well known in the art, and described in Bogdanove and Voytas, Science. 2011 Sep. 30; 333(6051): 1843-6.

Recombinant Nucleic Acids Encoding Recombinant Proteins

Certain aspects of the present disclosure relate to recombinant nucleic acids encoding recombinant proteins that contain a heterologous DNA-binding domain. The recombinant proteins may be SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins. Examples of heterologous DNA-binding domains may include, a CCCH zinc finger domain, a multi-cysteine zinc finger domain, a zinc binuclear cluster domain, a C2H2 zinc finger domain having less than three zinc fingers, a C2H2 zinc finger domain having more than three zinc fingers, a zinc finger array, a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

In one aspect, the present disclosure provides a recombinant nucleic acid encoding an SHH1-like protein, where the SHH1-like protein contains a DNA-binding domain and an SHH1 polypeptide or a fragment thereof. In some embodiments, the SHH1 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 1.

In one aspect, the present disclosure provides a recombinant nucleic acid encoding an SUVH2-like protein, where the SUVH2-like protein contains a DNA-binding domain and a SUVH2 polypeptide or a fragment thereof. In some embodiments, the SUVH2 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 14.

In one aspect, the present disclosure provides a recombinant nucleic acid encoding an SUVH9-like protein, where the SUVH9-like protein contains a DNA-binding domain and a SUVH9 polypeptide or a fragment thereof. In some embodiments, the SUVH9 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 27.

In one aspect, the present disclosure provides a recombinant nucleic acid encoding a DMS3-like protein, where the DMS3-like protein contains a DNA-binding domain and a DMS3 polypeptide or a fragment thereof. In some embodiments, the DMS3 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 41.

In one aspect, the present disclosure provides a recombinant nucleic acid encoding a MORC6-like protein, where the MORC6-like protein contains a DNA-binding domain and a MORC6 polypeptide or a fragment thereof. In some embodiments, the MORC6 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 53.

In one aspect, the present disclosure provides a recombinant nucleic acid encoding a SUVR2-like protein, where the SUVR2-like protein contains a DNA-binding domain and a SUVR2 polypeptide or a fragment thereof. In some embodiments, the SUVR2 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 66.

In one aspect, the present disclosure provides a recombinant nucleic acid encoding a DRD1-like protein, where the DRD1-like protein contains a DNA-binding domain and a DRD1 polypeptide or a fragment thereof. In some embodiments, the DRD1 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 79.

In one aspect, the present disclosure provides a recombinant nucleic acid encoding a RDM1-like protein, where the RDM1-like protein contains a DNA-binding domain and a RDM1 polypeptide or a fragment thereof. In some embodiments, the RDM1 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 91.

In one aspect, the present disclosure provides a recombinant nucleic acid encoding a DRM3-like protein, where the DRM3-like protein contains a DNA-binding domain and a DRM3 polypeptide or a fragment thereof. In some embodiments, the DRM3 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 101.

In one aspect, the present disclosure provides a recombinant nucleic acid encoding a DRM2-like protein, where the DRM2-like protein contains a DNA-binding domain and a DRM2 polypeptide or a fragment thereof. In some embodiments, the DRM2 polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 113.

In one aspect, the present disclosure provides a recombinant nucleic acid encoding a FRG-like protein, where the FRG-like protein contains a DNA-binding domain and a FRG polypeptide or a fragment thereof. In some embodiments, the FRG polypeptide or fragment thereof has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 125.

Target Nucleic Acids of the Present Disclosure

Other aspects of the present disclosure relate to utilizing recombinant proteins to reduce the expression of one or more genes of interest in plants by binding to one or more target nucleic acids associated with the genes of interest. The recombinant proteins may be SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins. In some embodiments, the SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins reduce expression of a gene of interest by binding to a target nucleic acid. In some embodiments, the SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins silence expression of a gene of interest by binding to a target nucleic acid.

In some embodiments, a target nucleic acid of the present disclosure is a nucleic acid that is located at any location within a target gene that provides a suitable location for reducing expression of the target gene. The target nucleic acid may be located within the coding region of a target gene or upstream or downstream thereof. Moreover, the target nucleic acid may reside endogenously in a target gene or may be inserted into the gene, e.g., heterologous, for example, using techniques such as homologous recombination. For example, a target gene of the present disclosure can be operably linked to a control region, such as a promoter, that contains a sequence that is recognized and bound by SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins of the present disclosure.

The target nucleic acid may be any given nucleic acid of interest that can be bound by an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure. In some embodiments, the target nucleic acid is endogenous to the plant where the expression of one or more genes is reduced by an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure. In some embodiments, the target nucleic acid is a transgene of interest that has been inserted into a plant. Methods of introducing transgenes into plants are well known in the art. Transgenes may be inserted into plants in order to provide a production system for a desired protein, or may be added to the genetic compliment in order to modulate the metabolism of a plant.

Examples of suitable endogenous plant genes whose expression can be reduced by an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure may include, for example, genes that prevent the enhancement of one or more desired traits and genes that prevent increased crop yields. For example, an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure may be used to reduce the expression of the gene GAI in plants, which would create plants that are less sensitive to gibberellin. In embodiments relating to research, an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure may be utilized to silence the expression of an endogenous gene of interest in order to generate mutant plants in which to study the function of the gene of interest.

Examples of suitable transgenes present in plants whose expression can be reduced by an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure may include, for example, transgenes that are not useful in certain genetic backgrounds, transgenes that are harmful in certain genetic backgrounds, and transgenes that are expressed in certain tissues that are undesirable. For example, in the case of transgenes that are expressed in certain tissues that are undesirable, an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure can be utilized to silence the expression of such transgenes in specific tissues at specific times by operably linking tissue specific promoters to the recombinant polypeptides of the present disclosure. In embodiments relating to research, an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure may be utilized to dynamically study transgenes of interest by controlling the induction/silencing of the transgenes.

Plants of the Present Disclosure

Certain aspects of the present disclosure relate to plants containing one or more SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins. In certain embodiments, the SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins bind to one or more target nucleic acids in the plant and reduce the expression of the one or more target nucleic acids.

As used herein, a "plant" refers to any of various photosynthetic, eukaryotic multi-cellular organisms of the kingdom Plantae, characteristically producing embryos, containing chloroplasts, having cellulose cell walls and lacking locomotion. As used herein, a "plant" includes any plant or part of a plant at any stage of development, including seeds, suspension cultures, plant cells, embryos, meristematic regions, callus tissue, leaves, roots, shoots, gametophytes, sporophytes, pollen, microspores, and progeny thereof. Also included are cuttings, and cell or tissue cultures. As used in conjunction with the present disclosure, plant tissue includes, without limitation, whole plants, plant cells, plant organs, e.g., leafs, stems, roots, meristems, plant seeds, protoplasts, callus, cell cultures, and any groups of plant cells organized into structural and/or functional units.

Any plant cell may be used in the present disclosure so long as it remains viable after being transformed with a sequence of nucleic acids. Preferably, the plant cell is not adversely affected by the transduction of the necessary nucleic acid sequences, the subsequent expression of the proteins or the resulting intermediates.

As disclosed herein, a broad range of plant types may be modified to incorporate an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein. Suitable plants that may be modified include both monocotyledonous (monocot) plants and dicotyledonous (dicot) plants.

Examples of suitable plants may include, for example, species of the Family Gramineae, including *Sorghum bicolor* and *Zea mays*; species of the genera: *Cucurbita, Rosa, Vitis, Juglans, Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersicon, Nicotiana, Solanum, Petunia, Digitalis, Majorana, Ciahorium, Helianthus, Lactuca, Bromus, Asparagus, Antirrhinum, Heterocallis, Nemesis, Pelargonium, Panieum, Pennisetum, Ranunculus, Senecio, Salpiglossis, Cucumis, Browaalia, Glycine, Pisum, Phaseolus, Lolium, Oryza, Avena, Hordeum, Secale*, and *Triticum*.

In some embodiments, plant cells may include, for example, those from corn (*Zea mays*), canola (*Brassica napus, Brassica rapa* ssp.), *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), duckweed (*Lemna*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucijra*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia* spp.), almond (*Prunus amygdalus*), sugar beets (*Beta vulgaris*), sugarcane (*Saccharum* spp.), oats, barley, vegetables, ornamentals, and conifers.

Examples of suitable vegetables plants may include, for example, tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*).

Examples of suitable ornamental plants may include, for example, azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbiapulcherrima*), and chrysanthemum.

Examples of suitable conifer plants may include, for example, loblolly pine (*Pinus taeda*), slash pine (*Pinus elliotii*), ponderosa pine (*Pinus ponderosa*), lodgepole pine (*Pinus contorta*), Monterey pine (*Pinus radiata*), Douglas-fir (*Pseudotsuga menziesii*), Western hemlock (*Isuga canadensis*), Sitka spruce (*Picea glauca*), redwood (*Sequoia sempervirens*), silver fir (*Abies amabilis*), balsam fir (*Abies balsamea*), Western red cedar (*Thuja plicata*), and Alaska yellow-cedar (*Chamaecyparis nootkatensis*).

Examples of suitable leguminous plants may include, for example, guar, locust bean, fenugreek, soybean, garden beans, cowpea, mungbean, lima bean, fava bean, lentils, chickpea, peanuts (*Arachis* sp.), crown vetch (*Vicia* sp.), hairy vetch, adzuki bean, lupine (*Lupinus* sp.), trifolium, common bean (*Phaseolus* sp.), field bean (*Pisum* sp.), clover (*Melilotus* sp.) Lotus, trefoil, lens, and false indigo.

Examples of suitable forage and turf grass may include, for example, alfalfa (*Medicago* s sp.), orchard grass, tall fescue, perennial ryegrass, creeping bent grass, and redtop.

Examples of suitable crop plants and model plants may include, for example, *Arabidopsis*, corn, rice, alfalfa, sunflower, canola, soybean, cotton, peanut, sorghum, wheat, tobacco, and lemna.

The plants of the present disclosure may be genetically modified in that recombinant nucleic acids have been introduced into the plants, and as such the genetically modified plants do not occur in nature. A suitable plant of the present disclosure is one capable of expressing one or more nucleic acid constructs encoding one or more recombinant proteins. The recombinant proteins encoded by the nucleic acids may be SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins.

As used herein, the terms "transgenic plant" and "genetically modified plant" are used interchangeably and refer to a plant which contains within its genome a recombinant nucleic acid. Generally, the recombinant nucleic acid is stably integrated within the genome such that the polynucleotide is passed on to successive generations. However, in certain embodiments, the recombinant nucleic acid is transiently expressed in the plant. The recombinant nucleic acid may be integrated into the genome alone or as part of a recombinant expression cassette. "Transgenic" is used herein to include any cell, cell line, callus, tissue, plant part or plant, the genotype of which has been altered by the presence of exogenous nucleic acid including those transgenics initially so altered as well as those created by sexual crosses or asexual propagation from the initial transgenic.

"Recombinant nucleic acid" or "heterologous nucleic acid" or "recombinant polynucleotide" as used herein refers to a polymer of nucleic acids wherein at least one of the following is true: (a) the sequence of nucleic acids is foreign to (i.e., not naturally found in) a given host cell; (b) the sequence may be naturally found in a given host cell, but in an unnatural (e.g., greater than expected) amount; or (c) the sequence of nucleic acids contains two or more subsequences that are not found in the same relationship to each other in nature. For example, regarding instance (c), a recombinant nucleic acid sequence will have two or more sequences from unrelated genes arranged to make a new functional nucleic acid. Specifically, the present disclosure describes the introduction of an expression vector into a plant cell, where the expression vector contains a nucleic acid sequence coding for a protein that is not normally found in a plant cell or contains a nucleic acid coding for a protein that is normally found in a plant cell but is under the control of different regulatory sequences. With reference to the plant cell's genome, then, the nucleic acid sequence that codes for the protein is recombinant. A protein that is referred to as recombinant generally implies that it is encoded by a recombinant nucleic acid sequence in the plant cell.

A "recombinant" polypeptide, protein, or enzyme of the present disclosure, is a polypeptide, protein, or enzyme that is encoded by a "recombinant nucleic acid" or "heterologous nucleic acid" or "recombinant polynucleotide."

In some embodiments, the genes encoding the recombinant proteins in the plant cell may be heterologous to the plant cell. In certain embodiments, the plant cell does not naturally produce the recombinant proteins, and contains heterologous nucleic acid constructs capable of expressing one or more genes necessary for producing those molecules.

Expression of Recombinant Proteins in Plants

An SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure may be introduced into plant cells via any suitable methods known in the art. For example, an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein can be exogenously added to plant cells and the plant cells are maintained under conditions such that the SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein binds to one or more target nucleic acids and reduces the expression of the target nucleic acids in the plant cells. Alternatively, a recombinant nucleic acid encoding an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure can be expressed in plant cells and the plant cells are maintained under conditions such that the expressed SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein binds to one or more target nucleic acids and reduces the expression of the target gene in the plant cells. Additionally, in some embodiments, an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure may be transiently expressed in a plant via viral infection of the plant, or by introducing an SHH1-like protein-encoding RNA, a SUVH2-like protein-encoding RNA, a SUVH9-like protein-encoding RNA, a DMS3-like protein-encoding RNA, a MORC6-like protein-encoding RNA, a SUVR2-like protein-encoding RNA, a DRD1-like protein-encoding RNA, an RDM1-like protein-encoding RNA, a DRM3-like protein-encoding RNA, a DRM2-like protein-encoding RNA, and/or an FRG-like protein-encoding RNA into a plant to temporarily reduce or silence the expression of a gene of interest. Methods of introducing recombinant proteins via viral infection or via the introduction of RNAs into plants are well known in the art. For example, Tobacco rattle virus (TRV) has been successfully used to introduce zinc finger nucleases in plants to cause genome modification ("Nontransgenic Genome Modification in Plant Cells", Plant Physiology 154:1079-1087 (2010)).

A recombinant nucleic acid encoding an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure can be expressed in a plant with any suitable plant expression vector. Typical vectors useful for expression of recombinant nucleic acids in higher plants are well known in the art and include, without limitation, vectors derived from the tumor-inducing (Ti) plasmid of *Agrobacterium tumefaciens* (e.g., see Rogers et al., Meth. in Enzymol. (1987) 153:253-277). These vectors are plant integrating vectors in that on transformation, the vectors integrate a portion of vector DNA into the genome of the host plant. Exemplary *A. tumefaciens* vectors useful herein are plasmids pKYLX6 and pKYLX7 (e.g., see of Schardl et al., Gene (1987) 61:1-11; and Berger et al., Proc. Natl. Acad. Sci. USA (1989) 86:8402-8406); and plasmid pBI 101.2 that is available from Clontech Laboratories, Inc. (Palo Alto, Calif.).

In addition to regulatory domains, an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure can be expressed as a fusion protein that is coupled to, for example, a maltose binding protein ("MBP"), glutathione S transferase (GST), hexahistidine, c-myc, or the FLAG epitope for ease of purification, monitoring expression, or monitoring cellular and subcellular localization.

Moreover, a recombinant nucleic acid encoding an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure can be modified to improve expression of the recombinant protein in plants by using codon preference. When the recombinant nucleic acid is prepared or altered synthetically, advantage can be taken of known codon preferences of the intended plant host where the nucleic acid is to be expressed. For example, recombinant nucleic acids of the present disclosure can be modified to account for the specific codon preferences and GC content preferences of monocotyledons and dicotyledons, as these preferences have been shown to differ (Murray et al., Nucl. Acids Res. (1989) 17: 477-498).

In some embodiments, SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins of the present disclosure can be used to create functional "gene knockout" mutations in a plant by repression of the target gene expression. Repression may be of a structural gene, e.g., one encoding a protein having for example enzymatic activity, or of a regulatory gene, e.g., one encoding a protein that in turn regulates expression of a structural gene.

The present disclosure further provides expression vectors containing an SHH1-like protein-encoding nucleic acid, a SUVH2-like protein-encoding nucleic acid, a SUVH9-like protein-encoding nucleic acid, a DMS3-like protein-encoding nucleic acid, a MORC6-like protein-encoding nucleic acid, a SUVR2-like protein-encoding nucleic acid, a DRD1-like protein-encoding nucleic acid, an RDM1-like protein-encoding nucleic acid, a DRM3-like protein-encoding nucleic acid, a DRM2-like protein-encoding nucleic acid, and/or an FRG-like protein-encoding nucleic acid of the present disclosure. A nucleic acid sequence coding for the desired recombinant nucleic acid of the present disclosure can be used to construct a recombinant expression vector which can be introduced into the desired host cell. A recombinant expression vector will typically contain a nucleic acid encoding a recombinant protein of the present disclosure, operably linked to transcriptional initiation regulatory sequences which will direct the transcription of the nucleic acid in the intended host cell, such as tissues of a transformed plant.

For example, plant expression vectors may include (1) a cloned plant gene under the transcriptional control of 5' and 3' regulatory sequences and (2) a dominant selectable marker. Such plant expression vectors may also contain, if desired, a promoter regulatory region (e.g., one conferring inducible or constitutive, environmentally- or developmentally-regulated, or cell- or tissue-specific/selective expression), a transcription initiation start site, a ribosome binding site, an RNA processing signal, a transcription termination site, and/or a polyadenylation signal.

A plant promoter, or functional fragment thereof, can be employed to control the expression of a recombinant nucleic acid of the present disclosure in regenerated plants. The selection of the promoter used in expression vectors will determine the spatial and temporal expression pattern of the recombinant nucleic acid in the modified plant, e.g., the SHH1-like protein-encoding nucleic acid, a SUVH2-like protein-encoding nucleic acid, a SUVH9-like protein-encoding nucleic acid, a DMS3-like protein-encoding nucleic acid, a MORC6-like protein-encoding nucleic acid, a SUVR2-like protein-encoding nucleic acid, a DRD1-like protein-encoding nucleic acid, an RDM1-like protein-encoding nucleic acid, a DRM3-like protein-encoding nucleic acid, a DRM2-like protein-encoding nucleic acid, and/or an FRG-like protein-encoding nucleic acid is only expressed in the desired tissue or at a certain time in plant development or growth. Certain promoters will express recombinant nucleic acids in all plant tissues and are active under most environmental conditions and states of development or cell differentiation (i.e., constitutive promoters). Other promoters will express recombinant nucleic acids in specific cell types (such as leaf epidermal cells, mesophyll cells, root cortex cells) or in specific tissues or organs (roots, leaves or flowers, for example) and the selection will reflect the desired location of accumulation of the gene product. Alternatively, the selected promoter may drive expression of the recombinant nucleic acid under various inducing conditions.

Examples of suitable constitutive promoters may include, for example, the core promoter of the Rsyn7, the core CaMV 35S promoter (Odell et al., Nature (1985) 313:810-812), CaMV 19S (Lawton et al., 1987), rice actin (Wang et al., 1992; U.S. Pat. No. 5,641,876; and McElroy et al., Plant Cell (1985) 2:163-171); ubiquitin (Christensen et al., Plant Mol. Biol. (1989)12:619-632; and Christensen et al., Plant Mol. Biol. (1992) 18:675-689), pEMU (Last et al., Theor. Appl. Genet. (1991) 81:581-588), MAS (Velten et al., EMBO J. (1984) 3:2723-2730), nos (Ebert et al., 1987), Adh (Walker et al., 1987), the P- or 2'-promoter derived from T-DNA of *Agrobacterium tumefaciens*, the Smas promoter, the cinnamyl alcohol dehydrogenase promoter (U.S. Pat. No. 5,683,439), the Nos promoter, the pEmu promoter, the rubisco promoter, the GRP 1-8 promoter, and other transcription initiation regions from various plant genes known to those of skilled artisans, and constitutive promoters described in, for example, U.S. Pat. Nos. 5,608,149; 5,608,144; 5,604,121; 5,569,597; 5,466,785; 5,399,680; 5,268,463; and 5,608,142.

Examples of suitable tissue specific promoters may include, for example, the lectin promoter (Vodkin et al., 1983; Lindstrom et al., 1990), the corn alcohol dehydrogenase 1 promoter (Vogel et al., 1989; Dennis et al., 1984), the corn light harvesting complex promoter (Simpson, 1986; Bansal et al., 1992), the corn heat shock protein promoter (Odell et al., Nature (1985) 313:810-812; Rochester et al., 1986), the pea small subunit RuBP carboxylase promoter (Poulsen et al., 1986; Cashmore et al., 1983), the Ti plasmid mannopine synthase promoter (Langridge et al., 1989), the Ti plasmid nopaline synthase promoter (Langridge et al., 1989), the petunia chalcone isomerase promoter (Van Tunen et al., 1988), the bean glycine rich protein 1 promoter (Keller et al., 1989), the truncated CaMV 35s promoter (Odell et al., Nature (1985) 313:810-812), the potato patatin promoter (Wenzler et al., 1989), the root cell promoter (Conkling et al., 1990), the maize zein promoter (Reina et al., 1990; Kriz et al., 1987; Wandelt and Feix, 1989; Langridge and Feix, 1983; Reina et al., 1990), the globulin-1 promoter (Belanger and Kriz et al., 1991), the α-tubulin promoter, the cab promoter (Sullivan et al., 1989), the PEPCase promoter (Hudspeth & Grula, 1989), the R gene complex-associated promoters (Chandler et al., 1989), and the chalcone synthase promoters (Franken et al., 1991).

Alternatively, the plant promoter can direct expression of a recombinant nucleic acid of the present disclosure in a specific tissue or may be otherwise under more precise environmental or developmental control. Such promoters are referred to here as "inducible" promoters. Environmental conditions that may affect transcription by inducible promoters include, without limitation, pathogen attack, anaerobic conditions, or the presence of light. Examples of inducible promoters include, without limitation, the AdhI promoter which is inducible by hypoxia or cold stress, the Hsp70 promoter which is inducible by heat stress, and the PPDK promoter which is inducible by light. Examples of promoters under developmental control include, without limitation, promoters that initiate transcription only, or preferentially, in certain tissues, such as leaves, roots, fruit, seeds, or flowers. An exemplary promoter is the anther specific promoter 5126 (U.S. Pat. Nos. 5,689,049 and 5,689,051). The operation of a promoter may also vary depending on its location in the genome. Thus, an inducible promoter may become fully or partially constitutive in certain locations.

Moreover, any combination of a constitutive or inducible promoter, and a non-tissue specific or tissue specific promoter may be used to control the expression of an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein.

Both heterologous and endogenous promoters can be employed to direct expression of recombinant nucleic acids of the present disclosure. Accordingly, in certain embodiments, expression of an SHH1-like protein-encoding nucleic acid, a SUVH2-like protein-encoding nucleic acid, a SUVH9-like protein-encoding nucleic acid, a DMS3-like protein-encoding nucleic acid, a MORC6-like protein-encoding nucleic acid, a SUVR2-like protein-encoding nucleic acid, a DRD1-like protein-encoding nucleic acid, an RDM1-like protein-encoding nucleic acid, a DRM3-like protein-encoding nucleic acid, a DRM2-like protein-encoding nucleic acid, and/or an FRG-like protein-encoding nucleic acid of the present disclosure is under the control of its respective endogenous promoter. In other embodiments, expression of an SHH1-like protein-encoding nucleic acid, a SUVH2-like protein-encoding nucleic acid, a SUVH9-like protein-encoding nucleic acid, a DMS3-like protein-encoding nucleic acid, a MORC6-like protein-encoding nucleic acid, a SUVR2-like protein-encoding nucleic acid, a DRD1-like protein-encoding nucleic acid, an RDM1-like protein-encoding nucleic acid, a DRM3-like protein-encoding nucleic acid, a DRM2-like protein-encoding nucleic acid, and/or an FRG-like protein-encoding nucleic acid of the present disclosure is under the control of a heterologous promoter. Additionally, an endogenous SHH1 gene, SUVH2 gene, SUVH9 gene, DMS3 gene, MORC6 gene, SUVR2 gene, DRD1 gene, RDM1 gene, DRM3 gene, DRM2 gene, and/or FRG gene of the present disclosure can be modified using a knock-in approach, so that the modified gene will be under the control of its respective endogenous elements. Alternatively, a modified form of an entire SHH1, SUVH2, SUVH9, DMS3, MORC6, SUVR2, DRD1, RDM1, DRM3, DRM2, and/or FRG genomic sequence may be introduced into a plant, so that the modified/recombinant gene will be under the control of its endogenous elements and the wild-type gene remains intact. Any or all of these techniques may also be combined to direct the expression of a recombinant nucleic acid of the present disclosure.

The recombinant nucleic acids of the present disclosure, such as an SHH1-like protein-encoding nucleic acid, a SUVH2-like protein-encoding nucleic acid, a SUVH9-like protein-encoding nucleic acid, a DMS3-like protein-encoding nucleic acid, a MORC6-like protein-encoding nucleic acid, a SUVR2-like protein-encoding nucleic acid, a DRD1-like protein-encoding nucleic acid, an RDM1-like protein-encoding nucleic acid, a DRM3-like protein-encoding nucleic acid, a DRM2-like protein-encoding nucleic acid, and/or an FRG-like protein-encoding nucleic acid, and/or a vector housing a recombinant nucleic acid of the present disclosure, may also contain a regulatory sequence that serves as a 3' terminator sequence. One of skill in the art would readily recognize a variety of terminators that may be used in the recombinant nucleic acids of the present disclosure. For example, a recombinant nucleic acid of the present disclosure may contain a 3' NOS terminator. Further, a native terminator from an SHH1-like protein-encoding nucleic acid, a SUVH2-like protein-encoding nucleic acid, a SUVH9-like protein-encoding nucleic acid, a DMS3-like protein-encoding nucleic acid, a MORC6-like protein-encoding nucleic acid, a SUVR2-like protein-encoding nucleic acid, a DRD1-like protein-encoding nucleic acid, an RDM1-like protein-encoding nucleic acid, a DRM3-like protein-encoding nucleic acid, a DRM2-like protein-encoding nucleic acid, and/or an FRG-like protein-encoding nucleic acid may also be used in the recombinant nucleic acids of the present disclosure.

Plant transformation protocols as well as protocols for introducing recombinant nucleic acids of the present disclosure into plants may vary depending on the type of plant or plant cell, e.g., monocot or dicot, targeted for transformation. Suitable methods of introducing recombinant nucleic acids of the present disclosure into plant cells and subsequent insertion into the plant genome include, without limitation, microinjection (Crossway et al., Biotechniques (1986) 4:320-334), electroporation (Riggs et al., Proc. Natl. Acad Sci. USA (1986) 83:5602-5606), *Agrobacterium*-mediated transformation (U.S. Pat. No. 5,563,055), direct gene transfer (Paszkowski et al., EMBO J. (1984) 3:2717-2722), and ballistic particle acceleration (U.S. Pat. No. 4,945,050; Tomes et al. (1995). "Direct DNA Transfer into Intact Plant Cells via Microprojectile Bombardment," in Plant Cell, Tissue, and Organ Culture: Fundamental Methods, ed. Gamborg and Phillips (Springer-Verlag, Berlin); and McCabe et al., Biotechnology (1988) 6:923-926).

Additionally, SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins of the present disclosure can be targeted to a specific organelle within a plant cell. Targeting can be achieved by providing the recombinant protein with an appropriate targeting peptide sequence. Examples of such targeting peptides include, without limitation, secretory signal peptides (for secretion or cell wall or membrane targeting), plastid transit peptides, chloroplast transit peptides, mitochondrial target peptides, vacuole targeting peptides, nuclear targeting peptides, and the like (e.g., see Reiss et al., Mol. Gen. Genet. (1987) 209(1):116-121; Settles and Martienssen, Trends Cell Biol (1998) 12:494-501; Scott et al., J Biol Chem (2000) 10:1074; and Luque and Correas, J Cell Sci (2000) 113:2485-2495).

The modified plant may be grown into plants in accordance with conventional ways (e.g., see McCormick et al., Plant Cell. Reports (1986) 81-84.). These plants may then be grown, and pollinated with either the same transformed strain or different strains, with the resulting hybrid having the desired phenotypic characteristic. Two or more generations may be grown to ensure that the subject phenotypic characteristic is stably maintained and inherited and then seeds harvested to ensure the desired phenotype or other property has been achieved.

Methods of Reducing Gene Expression in Plants

Further aspects of the present disclosure relate to methods for reducing expression of one or more target nucleic acids, such as genes, in a plant by utilizing SHH1-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins. In one aspect, the present disclosure provides a method for reducing expression of one or more target nucleic acids in a plant, by providing a plant containing one or more recombinant polypeptides of the present disclosure, and growing the plant under conditions whereby the recombinant polypeptide(s) binds to one or more target nucleic acids of the present disclosure, thereby reducing expression of the one or more target genes. Any plant described herein and containing a recombinant polypeptide of the present disclosure may be used.

Growing conditions sufficient for the recombinant polypeptide expressed in the plant to bind to and reduce the expression of one or more target nucleic acids of the present disclosure are well known in the art and include any suitable growing conditions disclosed herein. Typically, the plant is grown under conditions sufficient to express the recombinant polypeptide, such as an SHH1-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein of the present disclosure, and for the expressed recombinant polypeptide to be localized to the nucleus of cells of the plant in order to bind to and reduce the expression of the target nucleic acids. Generally, the conditions sufficient for the expression of the recombinant polypeptide will depend on the promoter used to control the expression of the recombinant polypeptide. For example, if an inducible promoter is utilized, expression of the recombinant polypeptide in a plant will require that the plant to be grown in the presence of the inducer.

It is to be understood that while the present disclosure has been described in conjunction with the preferred specific embodiments thereof, the foregoing description is intended to illustrate and not limit the scope of the present disclosure. Other aspects, advantages, and modifications within the scope of the present disclosure will be apparent to those skilled in the art to which the present disclosure pertains.

The following examples are offered to illustrate provided embodiments and are not intended to limit the scope of the present disclosure.

EXAMPLES

Example 1

The following Example relates to the characterization of the *Arabidopsis thaliana* protein SHH1 and its involvement in promoting RNA-directed DNA methylation and gene silencing.

Materials and Methods

ChIP-Seq, BS-Seq and siRNA-Seq Library Construction and Sequencing

The first replicate of ChIP-seq libraries (NRPD1-Flag and Col) was generated using the Ovation Ultralow IL Multiplex System (NuGEN) while the second replicate (NRPD1-Flag, NRPD1-Flag; shh1, and Col) was generated using the Ovation Ultralow DR Multiplex System (NuGEN). Both sets of ChIP-seq libraries used 18 cycles for the library amplification step. BS-seq libraries were generated as previously reported (Cokus et al., 2008). siRNA-seq libraries were generated using the small RNA TruSeq kit (Illumina) following the manufacturer instructions with the exception that 15 cycles were used during the amplification step. The wild-type (Col) and nrpe1 BS-seq libraries used in this study were previously published (Zhong et al., 2012) and were subsequently reanalyzed. All libraries were sequenced using the HiSeq 2000 platform following manufacturer instructions (Illumina) at a length of 50 bp.

Mapping and Processing of Reads

Sequenced reads were base-called using the standard Illumina pipeline. For ChIP-seq and BS-seq libraries, only full 50 nt reads were retained, whereas for siRNA-seq libraries, reads had adapter sequence trimmed and were retained if they were between 18 nt and 28 nt in length. For ChIP-seq and siRNA-seq libraries, reads were mapped to the *Arabidopsis* genome (TAIR8) with Bowtie (Langmead et al., 2009) and only perfect matches that mapped uniquely to the genome were retained for further analysis although the total number of mapping reads, unique and non-unique, were used when normalizing the siRNA-seq libraries to total number of reads per library. For BS-seq libraries, reads were mapped using the BSseeker wrapper for Bowtie (Chen et al., 2010). For ChIP-seq and BS-seq, identical reads were collapsed into one read, whereas for siRNA-seq identical reads were retained. For methylation analysis, percent methylation was calculated as previously reported (Cokus et al., 2008) with the unmethylated chloroplast genome serving as the measure of non-bisulfite converted background methylation. For the second replicate of ChIP-seq, the NRPD1-Flag and Col libraries were sampled down to match the read total of the smaller library (the NRPD1-Flag; shh1 library).

DNA Methylation Analysis

For assessment of DNA methylation at siRNA clusters, only those clusters with at least one cytosine in the respective class being assayed (CG, CHG, or CHH), were considered. For calculating significance levels of methylation change via the Mann-Whitney U test of methylation levels for clusters within the different subclasses (FIG. 1E) the number of clusters within each subclass was down sampled to the smallest subclass (the drm2/nrpe1 subclass) to allow for comparable significance values between subclasses.

Identification of siRNA Clusters

Small RNA clusters in the *Arabidopsis* genome were defined in a manner similar to a previously published approach (Heisel et al., 2008). In brief, the genome was divided into 200 bp bins, and the average coverage per bin of non-identical siRNA reads was calculated in two technical replicates of the wild-type (Col) library. This average was used assay the significance of the number of non-identical reads at a given bin in wild-type plants, assuming a Poisson distribution of such counts. In the R environment a Poisson exact test was carried out for each bin, and bins with a P-value less than 1e-5 in each wild-type technical replicate were considered as clusters.

Once clusters were defined, comparisons between read counts, including identical reads, were carried out for each mutant and the wild-type (Col) library using a Fisher's Exact Test. Resultant P-values were Benjamini-Hochberg adjusted to estimate FDRs, and clusters reduced in a mutant background at a FDR<1e-10 were then considered to be dependent on the wild-type function the mutant protein. For boxplot analysis of siRNA levels, the first technical replicate of the Col library was used as representative of Col siRNA levels. For calculating significance levels of siRNA change via the Mann-Whitney U test of siRNA levels for clusters within the different genotypic subclassess (FIG. 1D) the number of clusters within each subclass was down sampled to the smallest subclass (the drm2/nrpe1 subclass) to allow for comparable significance values between subclasses.

Identification of NRPD1 Peaks

The R package BayesPeak (Spyrou et al., 2009; Cairns et al., 2011) was used to identify regions of Pol-IV enrichment in a NRPD1-Flag ChIP-seq library as compared to a paired Col ChIP-seq control library done in parallel. Only high scoring peaks (PP>0.999) identified in both NRPD1-Flag ChIP-seq replicates (928 peaks) were retained for further analysis. For the purposes of assaying overlap of Pol IV peaks with siRNA clusters, "overlap" was called when >=1 bp of a peak overlaps with a locus.

To classify peaks as SHH1-dependent, -independent, or -enhanced, read counts over Pol IV peaks were compared between the NRPD1-Flag and NRPD1-Flag; shh1 ChIP-seq libraries, and significance was assessed using Fisher's Exact Test. Resultant P-values were Benjamini-Hochberg adjusted to estimate FDRs. Peaks with a loss of NRPD1 signal in the shh1 library at a FDR<0.001 were considered SHH1-dependent. Similarly, peaks that gained signal in shh1 at a FDR<0.001 were considered SHH1-enhanced. Peaks that fell into neither of these categories were considered SHH1-independent.

Protein Preparation

The gene encoding the SAWADEE domain of at SHH1 (residues 125-258) was cloned into a self-modified vector, which fuses a hexa-histidine tag plus a yeast sumo tag onto the N terminus of the target gene. The plasmid was transformed into the *E. coli* strain BL21 (DE3) RIL (Stratagene). The cells were cultured at 37° C. until the OD600 reached 0.8 and then the media was cooled to 20° C. and 0.2 mM IPTG was added to induce protein expression overnight. The recombinant expressed protein was first purified using a HisTrap FF column (GE Healthcare). The hexa-histidine-sumo tag was cleavage by the Ulp1 protease and removed by passing through a second HisTrap FF column. The pooled target protein was further purified using a Q FastFlow column and a Hiload Superdex G200 16/60 column (GE Healthcare) with buffer (150 mM NaCl, 20 mM Tris pH 8.0, and 5 mM DTT). In order to prepare the Se-methionine substituted protein, Leu200 and Leu218 of the SAWADEE domain were mutated to methionine using a QuikChange Site Directed Mutagenesis Kit (Stratagene). The Se-methionine substituted SAWADEE protein was purified using the same protocol as the wild-type protein. Peptides were synthesized at a peptide synthesis facility.

Crystallization

Crystallization of the SAWADEE domain was conducted at 4° C. using the sitting drop vapor diffusion method by mixing 1 μl of protein sample at a concentration of 5 mg/ml and 1 μl of reservoir solution (0.2 M NH4F and 20% PEG 3350), which was equilibrated against a 0.4 ml reservoir. 4-Cyclohexyl-1-Butyl-β-D-Maltoside (CYMAL®-4, Hampton Research) was added in the drop with a final concentration of 7.6 mM as an additive, which resulted in considerable improvement in crystal quality. Thin plate-shaped crystals appeared within 2 days. To generate crystals of complexes of SAWADEE domain with modified H3 peptides, the SAWADEE domain was mixed with peptides at a molar ratio of 1:2 at 4° C. for 1 hour. The crystals of the different complexes were grown under the same conditions as described for free SAWADEE protein. All the crystals were soaked into a reservoir solution supplemented with 20% glycerol for 2 minutes. The crystals were then mounted on a nylon loop for diffraction data collection. The diffraction data from the native SAWADEE protein and its Se-methionine substituted counterpart were collected at the NE-CAT beamline 24ID-C, Advanced Photon Source (APS), Argonne National Laboratory, Chicago, at the zinc peak and selenium peak, respectively. The data of the complex of the H3K9me3 peptide bound to the SAWADEE domain were collected at beamline X29A, National Synchrotron Light Source (NSLS) at Brookhaven National Laboratory, New York. The data on the SAWADEE domain in complex with H3K9me2, H3K9me1 and H3K4me1K9me1 peptides were collected at APS 241D-E. All the crystallographic data were processed with the HKL2000 program (Otwinowski et al., 2011).

Structure Determination and Refinement

The structure of the selenomethionine-substituted SAWADEE domain was solved using the single-wavelength anomalous dispersion (SAD) method as implemented in the Phenix program (Adams et al., 2010). The model building was carried out using the Coot program (Emsley et al., 2010) and structural refinement using the Phenix program. The structure of the wild type SAWADEE domain in the free state was solved using the molecular replacement method using the Phenix program. Zn2+ ions were identified and further confirmed by anomalous signal scattering. All the structures of SAWADEE domain in complexes with different modified H3 peptides were solved using the molecular replacement method with the same protocol as the native protein. Throughout the refinement, a free R factor was calculated using 5% random chosen reflections. The stereochemistry of the structural models were analyzed using the Procheck program (Laskowski et al., 1993). All the molecular graphics were generated with the Pymol program (DeLano Scientific LLC).

Isothermal Titration Calorimetry

All the binding experiments were performed on a Microcal calorimeter ITC 200 instrument at 6° C. First, protein samples were dialyzed overnight against a buffer of 100 mM NaCl, 2 mM β-mercaptoethanol and 20 mM HEPES, pH 7.5, at 4° C. Then the protein samples were diluted and the lyophilized peptides were dissolved with the same buffer. The titration was performed according to standard protocol and the data were fit using the Origin 7.0 program with a 1:1 binding model.

Modified Peptide Array Binding

A GST-SHH1 SAWADEE domain (125-258aa) construct was generated in the pENTR/TEV/D plasmid (Invitrogen), recombined into the pDEST 15 plasmid (Invitrogen) and transformed into the Rosetta 2 (DE3) bacterial cell line (Novagen). Protein expression was induced by the addition of 500 µL of 1M IPTG per 500 mL at an OD of 0.6 and cultures were grown at 16° C. overnight. At the time of induction the media was supplemented with 500 µL of 500 mM ZnSO4. The GST fusion protein was then purified as previously described (Johnson et al., 2008) and dialyzed into storage buffer (50 mM Tris pH 6.8, 300 mM NaCl, 40% glycerol, 2 mM DTT, 0.1% triton X-100). The purified GST-SHH1 (125-258aa) protein was used to probe a MODified™ Histone Peptide Array (Active Motif) under the following conditions: The array was blocked at 25° C. for 45 min in a 5% milk 1×TBS solution, washed three times in a 1×TBS-T solution at 25° C. for 5 minutes, and then probed overnight at 4° C. with the GST-SHH1 SAWADEE domain protein at a concentration of 6.5 µg/mL in Binding Buffer (50 mM HEPES pH7.5, 50 mM NaCl, 5% glycerol, 0.4 mg/mL BSA, 2 mM DTT). The array was then washed three times as above, and probed an HRP conjugated GST antibody at a 1:5000 dilution at 25° C. for 1 hour. The array then washed as detailed above and developed using an ECL Plus kit (GE healthcare).

Plant Lines, Site-Directed Mutagenesis, Southern and Western Blotting

The various previously characterized *Arabidopsis* RdDM mutant alleles, the complementing SHH1-3×Myc-BLRP transgenic plant line, and the pSHH1::SHH1-3×Myc-BLRP construct used are as previously described (Law et al., 2011). The pol-iv and pol-v mutants correspond to mutations in the nrpd1 and nrpe1 subunits of these polymerases, respectively. The structure-based mutations were generated in the pSHH1::SHH1-3×Myc-BLRP construct using a QuikChange Site Directed Mutagenesis Kit (Stratagene) and were transformed into the shh1-1 mutant background via the floral dip method. siRNA-seq and ChIP-seq experiments in the Col and RdDM mutant lines were conducted using floral tissue and BS-seq experiments were conducted using 10 day old seedlings. Southern and western blotting experiments were conducted using tissue from the same individual plant lines in the T1 generation and using previously described probes (Johnson et al., 2008) and antibodies (Law et al., 2010). The siRNA-seq and BS-seq experiments in the SAWADEE domain point mutant lines were conducted using floral tissue or 10 day old seedlings, respectively, from T3 plants homozygous for the various pSHH1::SHH1-3× Myc-BLRP transgenes. The Pol IV ChIP experiments and co-immunoprecipitation experiments in the various SAWADEE domain point mutant backgrounds were conducted using floral tissue from F1 plants that were homozygous for the shh1 mutant allele.

Results

To investigate the role of SHH1 in the RdDM pathway genome-wide, siRNA profiles were generated in wild-type Col plants, shh1 mutant plants, and several other RdDM mutants for comparison. In wild-type plants ~12,500 siRNA clusters were defined, representing 84.2% of all uniquely mapping 24 nt siRNAs. Consistent with previous findings, 81.4% of these siRNAs were Pol-IV-dependent (Mosher et al., 2008; Zhang et al., 2007) (FIG. 1A). Analysis of the siRNA clusters reduced in shh1 mutants demonstrated that SHH1 is a major regulator of siRNA levels, affecting 44% of Pol-IV-dependent clusters, which represents the majority of all 24 nt siRNAs, including a majority of the clusters that were reduced in two downstream RdDM mutants (drm2 and pol-v) (FIG. 1B). The overlap of the reduced siRNA clusters in these mutants formed four main subclasses (termed pol-iv only, shh1, shh1/drm2/pol-v, and drm2/pol-v; FIG. 1B), which were used for subsequent analyses. The clusters that depend solely on Pol-IV were more enriched in pericentromeric heterochromatin than those that also depend on SHH1, DRM2, and Pol-V (FIG. 1C), suggesting that different mechanisms may be controlling siRNA production in the euchromatic arms verses pericentromeric heterochromatin.

In shh1 mutants, siRNA levels at SHH1-dependent clusters (shh1 and shh1/drm2/pol-v subclasses) were reduced to nearly zero, while siRNA levels at SHH1-independent clusters experienced little to no change (FIG. 1D). These results demonstrate that SHH1 is a locus-specific RdDM component that has strong affects at a large subset of RdDM loci. Notably, the two downstream RdDM mutants (drm2 and pol-v) have the strongest effect on siRNAs levels at clusters that also require SHH1 (shh1/drm2/pol-v subclass), and these same clusters are amongst the highest siRNA producing clusters and correspond to the highest levels of CHH methylation in the genome (Cokus et al., 2008) (FIG. 1D, 1E). Together, these findings suggest that SHH1, and the downstream RdDM mutants, are specifically converging to control siRNA levels at the most active sites of RdDM.

Using whole-genome bisulfite sequencing (BS-seq), we assessed DNA methylation levels at the loci showing reduced siRNA levels and found that, consistent with its interaction with Pol-W, SHH1 is an upstream RdDM component; shh1 mutants only affect DNA methylation at sites where siRNA levels are reduced (FIG. 1E). Furthermore, the residual siRNAs present in shh1 mutants appear to target some methylation, as predicted for an upstream RdDM component. This is in contrast to the downstream mutants, drm2 and pol-v, which reduced DNA methylation to nearly pol-iv levels even at sites that largely retain siRNAs (FIG. 1E), presumably due to an inability to utilize siRNAs to target DNA methylation.

At loci corresponding to the shh1/drm2/pol-v and drm2/pol-v subclasses of siRNA clusters, the observed losses of siRNAs were accompanied with a correspondingly large loss of DNA methylation (FIG. 1E). However, at the pol-iv only and shh1 subclasses, large losses of siRNAs were accompanied by relatively little DNA methylation loss. Without wishing to be bound by theory, it is believed that a likely explanation for this finding is that other DNA methylation pathways are more active at sites corresponding to the pol-iv only and shh1 siRNA clusters. In addition to the RdDM pathway, DNA methylation is controlled by two maintenance methyltransferase pathways (Law and Jacobson, 2010): the DNA METHYLTRANSFERASE 1 (MET1) pathway, which acts to maintain CG methylation, and the CHROMOMETHYLTRANSFERASE 3 (CMT3) pathway, which acts along with several H3K9 histone methyltransferases to maintain CHG and some CHH methylation (Cao et al., 2003). Consistent with this notion of methyltransferase redundancy, the pol-iv only and shh1 subclasses of reduced siRNA clusters displayed the highest levels of CMT3 occupancy (Du et al., 2012) (FIG. 1F), suggesting that in the absence of a functional RdDM pathway the CMT3 pathway is able to maintain DNA methylation at nearly wild-type levels at these loci. In contrast, the shh1/drm2/pol-v and drm2/pol-v subclasses, which show dramatic DNA methylation losses in RdDM mutants, display lower levels of CMT3 enrichment (FIG. 1F) and are more highly and precisely enriched for the Pol-V polymerase (Zhong et al., 2012) (FIG. 1F, 1G), suggesting they are primarily targeted by the RdDM pathway.

Figure 2:
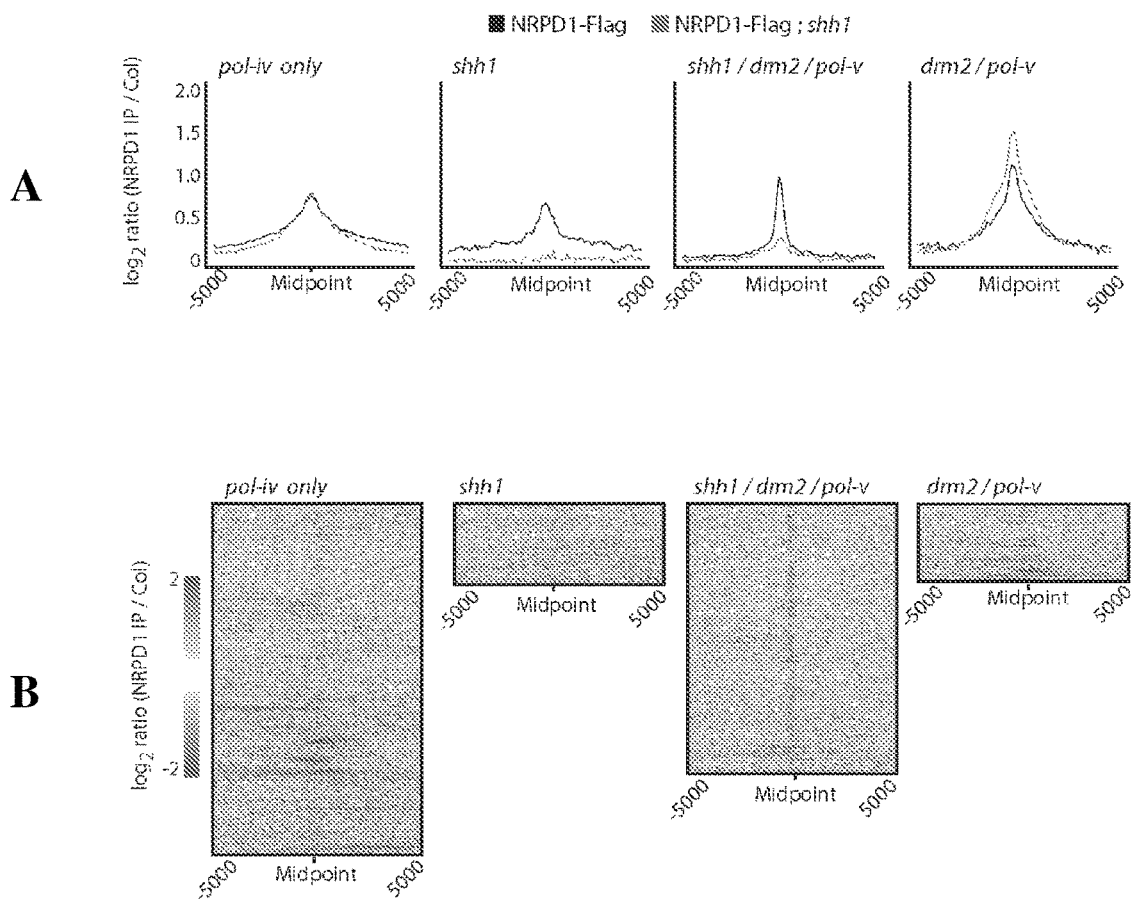
FIG. 2A-FIG. 2B illustrate Polymerase IV levels at defined siRNA clusters.

A genome-wide profile of Pol-IV occupancy in wild-type and shh1 mutant backgrounds was determined via chromatin immunoprecipitation of a Flag-tagged version of the largest Pol-IV subunit, NRPD1 (Law et al., 2011), followed by high throughput sequencing (ChIP-seq). Consistent with the profile of Pol-IV-dependent siRNA clusters, Pol-IV was broadly enriched at pericentromeric heterochromatin and at the defined subclasses of siRNA clusters (FIG. 2A, 2B). In the shh1 mutant background, Pol-IV levels were drastically reduced or eliminated specifically at shh1-dependent siRNA clusters (FIG. 2A), further supporting the biological relevance of the ChIP-seq profile and confirming that the reduced-siRNA phenotype of shh1 mutants is due to altered Pol-IV chromatin association. At shh1-independent siRNA clusters Pol-IV levels, like siRNA levels, were not reduced in an shh1 mutant (FIG. 2A), suggesting that Pol-IV targeting to these loci requires an alternative mechanism.

In addition to assessing the levels of Pol-IV enrichment over the affected siRNA cluster subclasses, 928 reproducible, high confidence Pol-IV peaks using multiple ChIP-seq datasets were defined. These peaks were enriched for siRNAs and DNA methylation and preferentially overlapped with the high siRNA-producing shh1/drm2/pol-v or drm2/pol-v clusters as compared to the pol-iv only and shh1 clusters (P<2.2e-16, Fisher's Exact Test), suggesting the ChIP procedure is preferentially identifying sites where Pol-IV is most active. At the 928 defined Pol-IV peaks, a variable level of SHH1-dependency was observed, prompting division of the peaks into three categories, SHH1-independent, SHH1-dependent, and SHH1-enhanced. In shh1 mutants, DNA methylation and siRNA levels were reduced at the SHH1-dependent sites and, to a lesser extent, at sites defined as SHH1-independent. However, siRNA and Pol-IV levels were increased at SHH1-enhanced sites in shh1 mutants, suggesting a redistribution of Pol-IV to these sites in shh1 mutants. These SHH1-enhanced sites are unique amongst the Pol-IV peaks as they display very low levels of Pol-V enrichment, which could explain the correspondingly low level of CHH methylation observed at these sites in wild-type plants. Together with the analysis of SHH1-dependent siRNA clusters, these findings demonstrate that SHH1 plays a critical role in facilitating Pol-IV chromatin association at a subset of the most active sites of RdDM. SHH1 thus represents the first factor known to affect the targeting of Pol-IV, controlling the initiation of RdDM.

Figure 3:
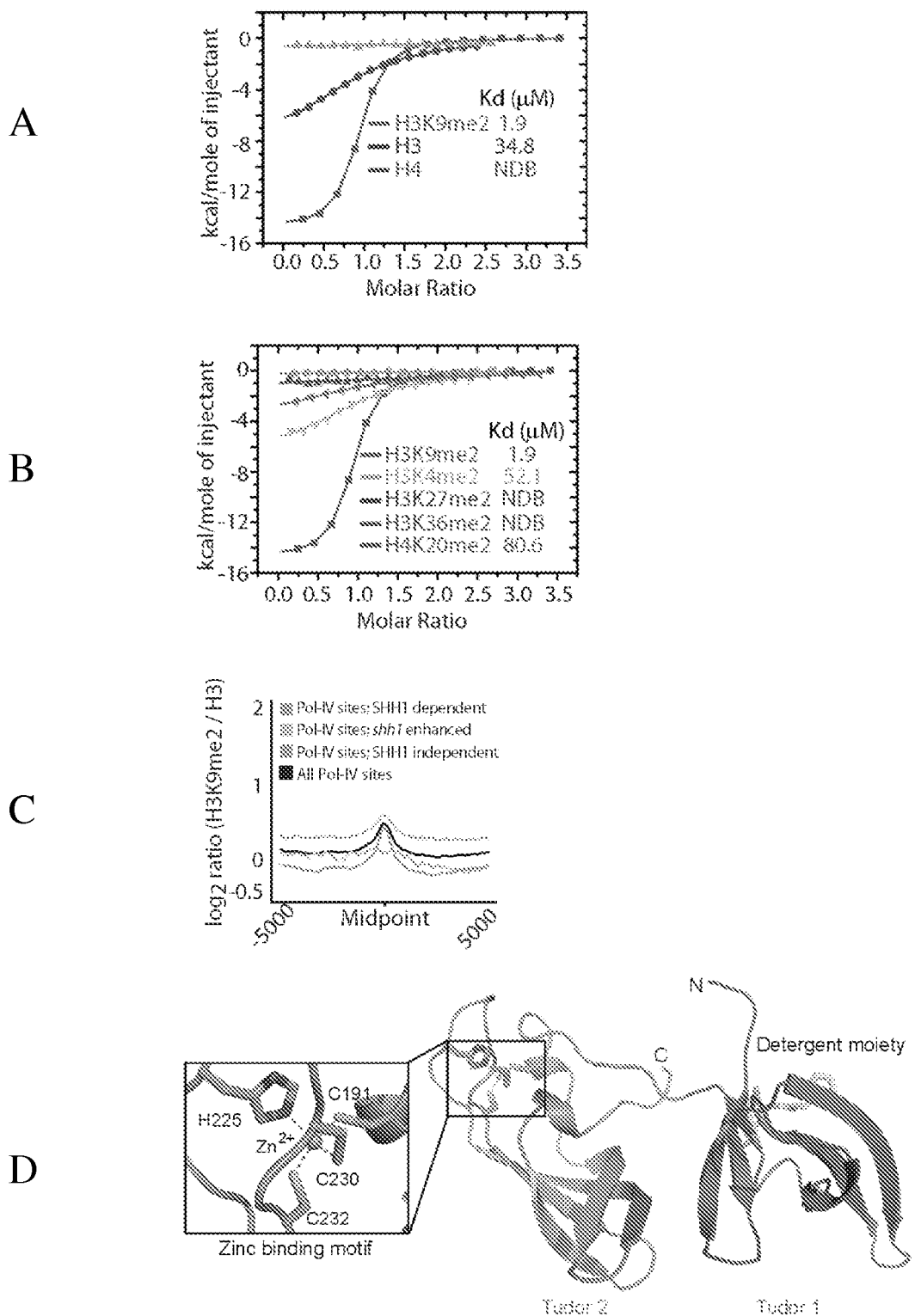
FIG. 3A-FIG. 3D illustrate that the SHH1 SAWADEE domain recognizes H3K9 methylation and adopts a unique tandem Tudor domain-like fold.
Figure 10:
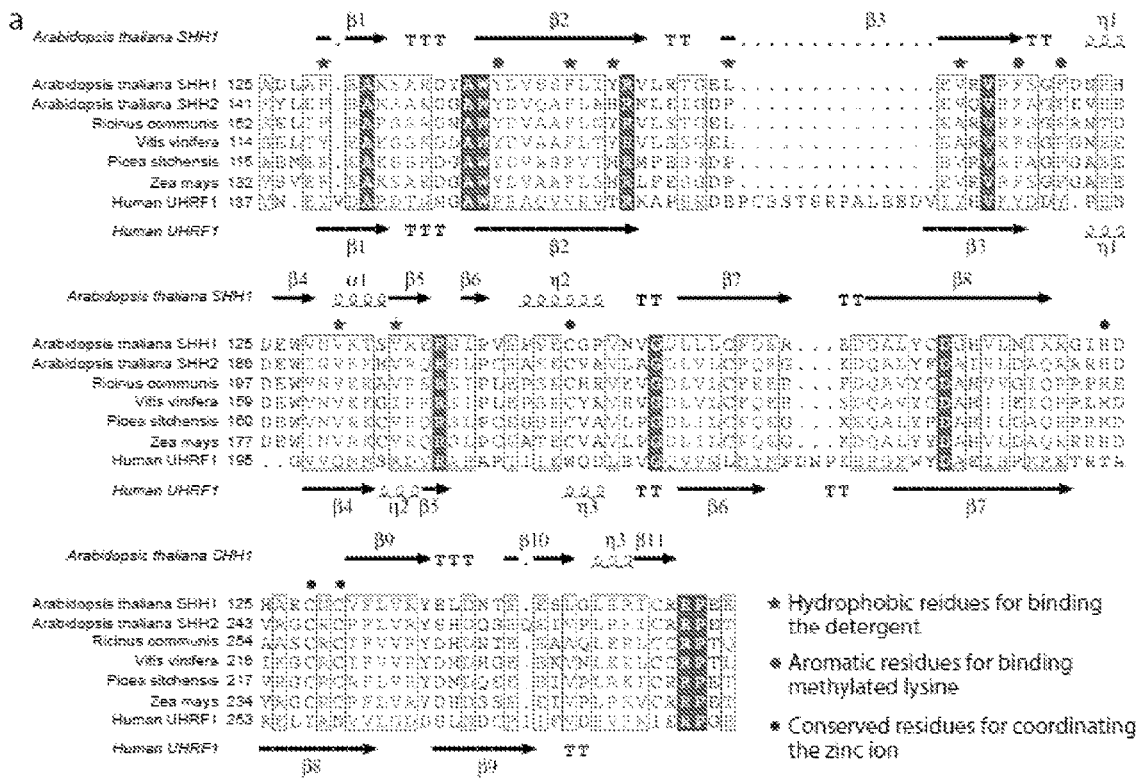
FIG. 10 illustrates structure based sequence alignment of *Arabidopsis thaliana* SHH1 (SEQ ID NO: 1), SHH2 (SEQ ID NO: 40), and the SAWADEE domains from SHH1 orthologs in other species, including *Ricinus communis* (SEQ ID NO: 2), *Vitis vinifera* (SEQ ID NO: 11), *Picea sitchensis* (SEQ ID NO: 176), and *Zea mays* (SEQ ID NO: 4). The tandem Tudor domain of human UHRF1 (SEQ ID NO: 177) is also included for comparison. The secondary structure of the SHH1 SAWADEE domain and the human UHRF1 tandem Tudor domain are presented on the top and bottom of the alignment, respectively. The partially conserved hydrophobic residues of the SAWADEE domain involved in binding the nonpolar tail of the detergent are marked by green stars. The conserved aromatic residues involved in recognition of methylated K9 are marked by purple hexagons. The conserved SAWADEE residues involved in coordinating the zinc ion are marked by black circles.

To gain insight into the mechanism through which SHH1 facilitates Pol-IV targeting, the function of its SAWADEE domain, a plant specific domain of unknown function (Mukherjee et al., 2009), was investigated. Sequence alignments of SHH1 proteins from diverse species are presented in FIG. 10. The ability of the SAWADEE domain to bind modified histone tails using an Active Motif modified peptide array was tested. This assay revealed that the SAWADEE domain has a preference for H3K9 methylation, but is also influenced by the methylation status of the H3K4 residue, with only unmodified or H3K4me1 modifications being tolerated. To confirm these results, isothermal calorimetry (ITC) experiments were conducted using modified histone tail peptides (FIG. 3A, 3B). These analyses revealed that the SAWADEE domain is quite unique in its ability to bind all three H3K9 methylation states (me1, me2, and me3) with very similar affinity, $K_d \approx 2$ µM, which is approximately 17 fold higher than observed using unmodified H3 peptides (FIG. 3A). ITC experiments also confirmed that while the SAWADEE domain will bind H3K9me2 peptides that contain H3K4me1 modifications, the presence of H3K4me2 or H3K4me3 modifications resulted in reduced binding affinity. Finally, ITC experiments using modified peptides corresponding to all other known methylated lysine residues on the N-terminal tails of the core histone proteins confirmed the specificity of the SHH1 SAWADEE domain for H3K9 methylation (FIG. 3B). Together, these binding studies demonstrate that the SAWADEE domain is a novel chromatin binding module that probes both the K4 and K9 positions of the H3 tail and specifically binds repressive H3K9 methyl-modifications.

Consistent with the observed in vitro binding specificity of the SHH1 SAWADEE domain, SHH1-dependent Pol-IV ChIP-seq peaks are enriched for H3K9me2 (FIG. 3B). Pol-IV ChIP-seq peaks are depleted for H3K4 methylation.

To determine the mode of methyl-lysine recognition by the SHH1 SAWADEE domain, crystal structures of this domain either in the free-state or in complex with modified H3 tails were solved (FIG. 3D). In the free-state, the SHH1 SAWADEE domain adopts a tandem Tudor domain-like fold that contains a unique zinc-binding motif located within the Tudor 2 subdomain (FIG. 3D), making SHH1 the founding member of a new subclass of tandem Tudor domain folds (Bian et al., 2011). In this structure, a zinc ion is coordinated by highly conserved cysteine and histidine residues (Mukherjee et al., 2009). A DALI search indicated that the overall structure of the SAWADEE domain resembles the UHRF1 tandem Tudor domain with an r.m.s.d. of 2.3 Å despite only sharing 11.8% sequence identity (Holm and Rosenstrom, 2010; Nady et al., 2011). This finding demonstrates that although the sequence of the SAWADEE domain is plant specific its fold is highly conserved in eukaryotic organisms.

Figure 4:
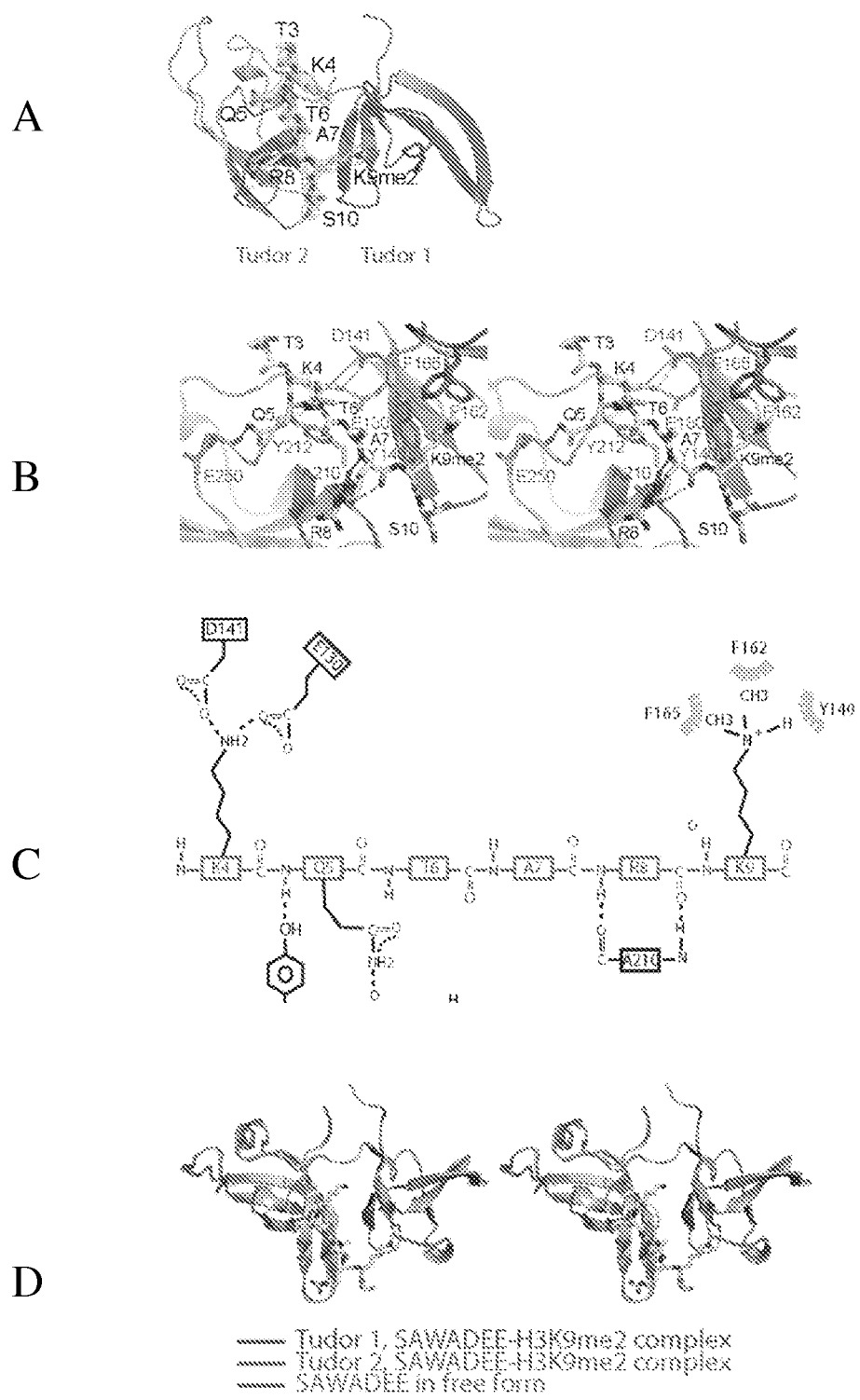
FIG. 4A-FIG. 4J illustrate the structural basis for recognition of H3(1-15)K9me2 peptide by the SHH1 SAWADEE domain and in vivo function analyses.
Figure 4:
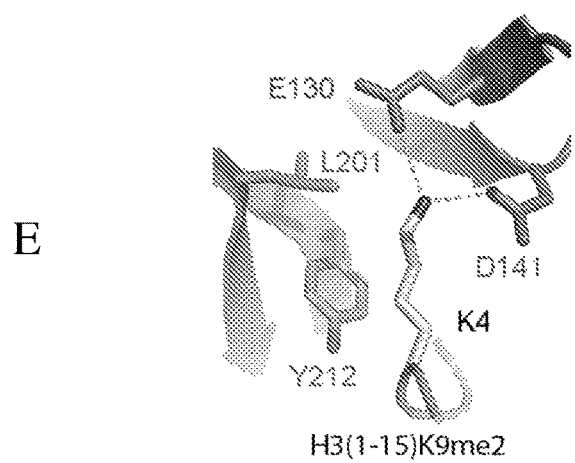
Figure 4:
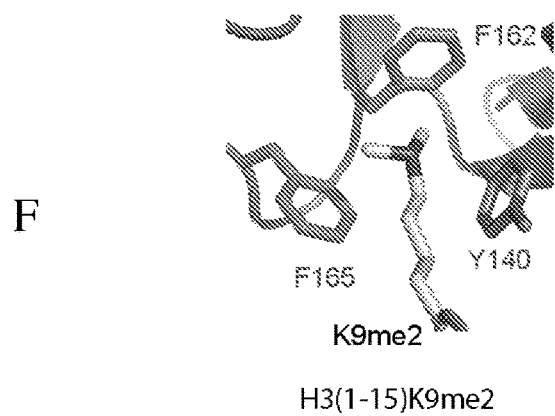
Figure 4:
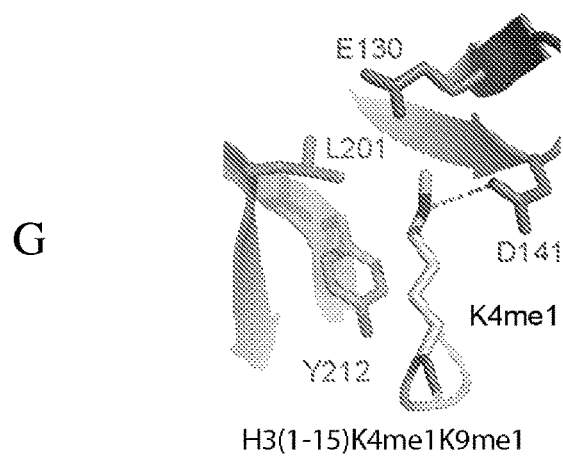
Figure 4:
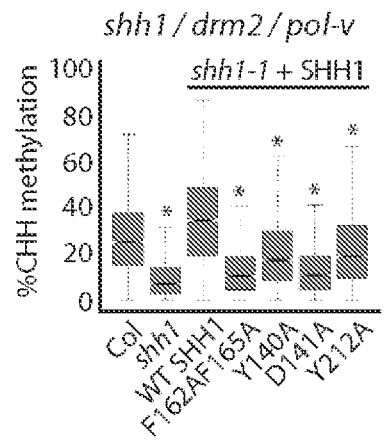
Figure 4:
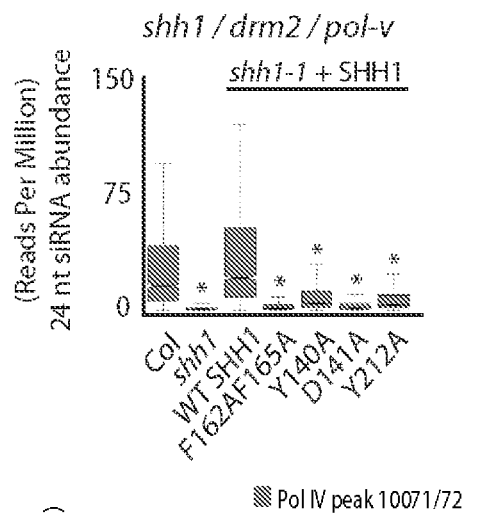
Figure 4:
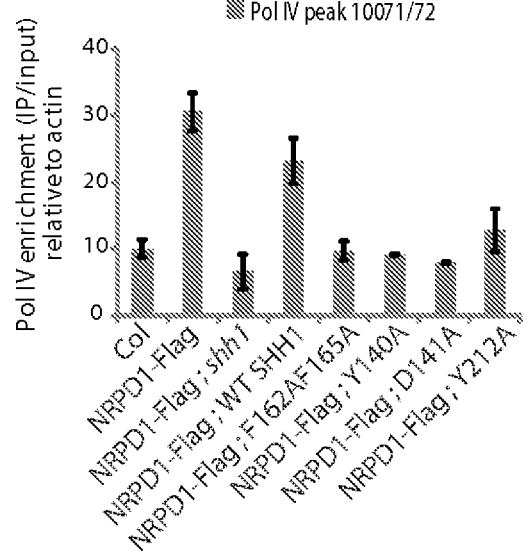

The structures of the SHH1 SAWADEE domain in complexes with H3K9me1, H3K9me2 and H3K9me3 peptides were also solved and all three peptides were bound in a similar manner. The 2.70 Å structure solved with an H3(1-15)K9me2 peptide (FIG. 4A) was further analyzed. This peptide binds with directionality in a groove between the two Tudor subdomains, forming contacts with both subdomains (FIG. 4A, 4B, 4C). The free and H3K9me2-bound structures of the SAWADEE domain can be well superpositioned (FIG. 4D) demonstrating that there is no significant conformational change in the SAWADEE domain upon ligand binding, a finding which differs from the situation reported for UHRF1 (Nady et al., 2011).

Within the SHH1 SAWADEE domain, there are two pockets that form intermolecular interactions with the unmodified K4 and the K9me2 side chains of the bound peptide (FIG. 4E, 4F). The unmodified H3K4 side chain inserts into an interfacial pocket formed by residues from both the Tudor 1 and Tudor 2 subdomains. In this pocket, the K4 side chain is stabilized via intermolecular hydrogen bonds and electrostatic interactions with the side chains of Glu130 and Asp141 (FIG. 4E). The H3K9me2 side chain inserts into a hydrophobic aromatic cage formed by residues of the Tudor 1 subdomain (FIG. 4F) where it is stabilized by cation-π interactions in a manner similar to those reported previously for methylated lysine-binding modules (Taverna et al., 2007). The H3K9me3-SAWADEE and H3K9me1-SAWADEE complexes also position the methylated lysines within the same aromatic cage. Without wishing to be bound by theory, it is believed that the ability of the SAWADEE domain to bind equally against all three H3K9 methylation states may be well explained by structural observations: the methylated lysine recognition aromatic cage can accommodate both H3K9me2 and H3K9me3 side chains through common hydrophobic interactions with the aromatic cage, resulting in a lack of discrimination between these two methylation states. In the H3K9me1 complex, although the lower lysine methylation state has a decreased hydrophobic interaction with the aromatic cage, the side chain of His169 undergoes a small but significant conformational change in order to hydrogen bond with the K9me1 ammonium proton, thereby contributing to the recovery of the binding affinity. This lack of specificity for the state of K9 methylation is in contrast to the higher level of methylation specificity observed for the tandem Tudor domain of UHRF1, which has a slightly wider aromatic cage binding pocket composed of a different combination of Phe and Tyr residues. Without wishing to be bound by theory, it is believed that this results in different shape complementarity requirements. The structural analysis indicates how very subtle changes in the tandem Tudor domain fold can result in a fine tuning of methyl-lysine specificity.

The structure of the SAWADEE domain in a complex with an H3(1-15)K4me1K9me1 peptide was also solved. Overall, this structure resembles the structure with the H3K9me2 peptide, with the K4me1 accommodated within the same K4 binding pocket. However, the methyl group forms a stabilizing hydrophobic interaction with Leu201 in place of the hydrogen bond that is formed between the ammonium proton of the unmethylated K4 and the Glu130 side chain (FIG. 4G). Since this K4 binding pocket is relatively closed and narrow, higher methylation states of K4 would likely introduce steric conflicts and/or disrupt all the hydrogen bonding interactions. Without wishing to be bound by theory, it is believed that this explains the observed decreases in binding affinity.

To test the biological significance of methyl-H3K9 binding activity observed for the SHH1 SAWADEE domain, point mutations were generated within the two lysine binding pockets as well as the zinc binding motif. The impact of these mutations on DNA methylation, siRNA levels, and Pol-IV recruitment in vivo were analyzed. Specifically, these point mutations were engineered into an SHH1-3×Myc-BLRP-construct and transformed into an shh1 mutant background. DNA methylation levels were assessed at a well characterized locus, MEA-ISR, by southern blotting and genome-wide by BS-seq experiments (FIG. 4H). Addition of a wild-type SHH1-3×Myc-BLRP transgene restored DNA methylation, but constructs harboring mutations within the H3K9 or the H3K4 pockets were unable to fully complement the methylation defect observed in the shh1 mutant (FIG. 4H) despite being expressed at levels comparable to the wild-type SHH1-3×Myc-BLRP protein. Mutations in the zinc coordinating residues resulted in nearly undetectable levels of protein and thus were not characterized further.

Similar to the shh1 null mutant, the DNA methylation defects in the SHH1 lysine binding pocket mutants is most pronounced in the shh1/drm2/pol-v subclass of affected siRNA clusters (FIG. 4H) and consistent with their positions and predicted contributions to the binding affinity of the SHH1 SAWADEE domain, the F162AF165A and the D141A mutants display stronger DNA methylation defects (FIG. 4H). In agreement with the observed reductions in DNA methylation, assessment of siRNA levels in the lysine binding pocket mutants via siRNA-seq experiments revealed a similar pattern of defects with the F162AF165A and the D141A mutants again displaying a stronger phenotype (FIG. 4I). To determine whether the observed losses of siRNAs and DNA methylation reflect a defect in Pol-IV activity at chromatin, Pol-IV ChIP experiments were conducted in the SAWADEE domain point mutant backgrounds. All four point mutants displayed reduced levels of Pol-IV occupancy in two biological replicates (FIG. 4J). In addition, co-immunoprecipitation showed that the SHH1 SAWADEE domain point mutants were still able to interact with Pol IV, demonstrating the interaction between SHH1 with the Pol IV complex in not dependent on its H3K9me binding activity. Together, these findings show that residues within both the K4 and K9 binding pockets are critical for SHH1 function in vivo and demonstrate a role for methyl-H3K9 binding by SHH1 at the level of Pol IV association to chromatin.

It was found that the H3K4 binding pocket is important for SHH1 function in vivo. The SHH1 SAWADEE does not bind H3K4 methylation in the absence of H3K9 methylation and the addition of a methyl group to K4 does not impart any additional binding affinity. Without wishing to be bound by theory, it is believed that the mere presence of a lysine at the position five residues back from the methylated H3K9 residue is necessary for SAWADEE domain binding. Such dual lysine reading could serve to help ensure that the SAWADEE domain only binds lysine methylation when it is present at the K9 position of the H3 tail as opposed to a methylated lysine at a different position on the H3 tail or even on a different histone or non-histone protein. ITC experiments were conducted using H3 tails harboring an H3K4A mutation with or without the presence of the H3K9me2 modification. The SAWADEE domain binds the H3K4AK9me2 peptide with approximately 30-fold weaker affinity than the H3K9me2 peptide. Furthermore, the SHH1 SAWADEE domain binds the H3K4A peptide with weaker affinity than the wild type H3 tail, demonstrating that the K4 residue is contributing to binding independent of the methylation status of the K9 residue.

Together, these in vivo and in vitro analyses demonstrate that the SHH1 SAWADEE domain is probing the H3 tail at both the K4 and K9 positions and is quite selective for the combination of histone modifications present at transposons and other repetitive DNA elements, namely unmodified H3K4 and methylated H3K9. Although H3K9 methylation is anti-correlated with H3K4 methylation genome-wide (Zhang et al., 2009). Without wishing to be bound by theory, it is believed that the aversion of the SAWADEE domain to higher order H3K4 methylation could serve to allow transcription, which is correlated with H3K4 methylation, to overcome DNA methylation and associated repressive H3K9 methyl modifications in a developmental or locus specific manner. Likewise, the specificity of the SAWADEE domain could inhibit siRNA generation at body methylated genes which contain CG methylation and H3K4 methyl-modifications, but lack CHG and CHH methylation as well as siRNAs (Cokus et al., 2008; Zhang et al., 2009; Zhang et al., 2006).

In summary, it was demonstrated that SHH1 is a novel chromatin binding protein that functions in RdDM to enable Pol-IV recruitment and/or stability at the most actively targeted genomic loci in order to promote siRNA biogenesis. Without wishing to be bound by theory, it is believed that the finding that SHH1 binds to repressive histone modifications, together with the observation that SHH1 is required for Pol-IV chromatin association at a similar set of loci as downstream RdDM mutants, could explain the previously observed self-reinforcing loop in which downstream RdDM mutants are required for the production of full levels of siRNAs from a subset of genomic loci (Zilberman et al., 2004; Xie et al., 2004; Li et al., 2006; Pontes et al., 2006) as it has been shown that downstream RdDM mutants can cause a reduction of both DNA methylation and H3K9 methylation at RdDM loci (Zilberman et al., 2003).

Example 2

The following Example relates to the characterization of the *Arabidopsis thaliana* proteins SUVH2 and SUVH9 and their involvement in promoting RNA-directed DNA methylation and gene silencing.

Introduction

Establishment of all DNA methylation and maintenance of much of the non-CG methylation involves the RNA-directed DNA methylation (RdDM) pathway (Aufsatz et al., 2002; Pelissier and Wassenegger, 2000). Without wishing to be bound by theory, it is believed that there are two main steps in this pathway that are thought to target the DNA methyltransferase, DOMAINS REARRANGED METHYLTRANSFERASE 2 (DRM2) (Cao and Jacobsen, 2002). The first upstream step involves the synthesis of 24 nucleotide small interfering RNAs (siRNAs) by the concerted actions of RNA POLYMERASE IV (Pol IV or NRPD), RNA-DIRECTED RNA POLYMERASE 2 (RDR2) and DICER-LIKE 3 (DCL3) (Pontier et al., 2005). The second downstream step involves the production of scaffold transcripts by RNA POLYMERASE V (Pol V or NRPE) with the help of the DDR complex (DRD1, a SWI/SNF2 chromatin remodeler; DMS3, a chromosomal architectural protein; RDM1, unknown function). Without wishing to be bound by theory, it is then believed that ARGONAUTE 4 (AGO4) loaded with a 24 nucleotide siRNA binds to Pol V transcripts and, in an unknown fashion, acts to direct DRM2 to DNA for methylation (Law et al., 2010; Pikaard et al., 2008; Wierzbicki et al., 2009).

This Example demonstrates that Pol V transcription and its stable binding to chromatin are dependent on SUVH2/SUVH9 genome-wide. These Pol V binding sites are enriched in DNA methylation and, in many cases, with histone H3K9 methylation. Furthermore, it is shown that tethering of SUVH2 to the unmethylated epiallele fwa-4 results in the establishment of DNA methylation and silencing of the FWA gene. This establishment of methylation coincides with recruitment of Pol V, but not with immediate enrichment of histone methylation, suggesting that histone methylation is secondary to the establishment of DNA methylation. A 2.4 Å crystal structure of SUVH9 is also shown, thereby defining the folds and relative orientations of the component domains in this family of enzymes. A two-helix bundle near the N-terminus is positioned between and interacts with the SRA and pre-SET/SET domains. An incompletely formed SAM cofactor-binding pocket, as well as the absence of a histone peptide substrate-binding cleft within the structure of SUVH9, was observed, reflecting the absence of the post-SET domain in this enzyme. Without wishing to be bound by theory, it is believed that this may explain its lack of methyltransferase activity in vitro. These results suggest that SUVH2 and SUVH9 function in the recruitment of Pol V to chromatin, providing Pol V with a means to read epigenetic marks to direct its activity.

Materials and Methods

Biological Materials

All plants used were of the *Arabidopsis thaliana* Columbia (Col-0) accession, with WT referring to the parental strain. The nrpe1-12 T-DNA (SALK_033852), the suvh2suvh9 double, suvh4suvh5suvh6 triple mutant lines were described previously (Johnson et al., 2008; Pontier et al., 2005). NRPE1-FLAG transgenic plants (El-Shami et al., 2007) were crossed to suvh2suvh9 double mutant and homozygous F2 plants were identified. The fwa-4 epiallele was isolated from a met1 segregating population in a Columbia background.

Pol V Transcription and Chromatin Immunoprecipitation

Total RNA was isolated from flowers using TRIzol reagent (Invitrogen) and used to synthesize first strand cDNA using SuperScript III (Invitrogen). Real-Time PCR was performed using the SYBR Green SuperMix (Bio-Rad) in MxPro3000 qPCR machine (Stratagene) following the manufacturer instruction. ChIPs were done using 1-2 grams of 3-week old plants or flowers and were either crosslinked in vivo or in vitro with 1% formaldehyde as previously described (Zhong et al., 2012). Anti-H3K9me1 was obtained from Upstate (#07-450), anti-H3K9me2 was obtained from Abcam (ab1220), and anti-NRPE1 was a gift from Craig Pikaard.

Library Generation

Libraries for histone ChIP-seq were generated using paired-end regents from NEB and adapters from the Illumina. Libraries for NRPE ChIP-seq were generated using the NuGen multiplex kits. BS-seq libraries were generated as previously reported (Feng, 2011). All libraries were sequenced using the HiSeq 2000 platform following manufacturer instructions (Illumina) at a length of 50 bp.

Alignment

Bisulfite-Seq and ChIP-seq reads were aligned to the TAIR8 version of the *Arabidopsis thaliana* reference genome using BS-seeker and bowtie, respectively, allowing for up to 2 mismatches. Only uniquely mapped reads were considered. ChIP-seq libraries were normalized such that all libraries would contain an equal number of reads. NRPE1-Flag enrichment over NRPE1 sites (Zhong et al., 2012) was normalized to Flag ChIP in Columbia (negative control). Histone methylation over NRPE sites was normalized to 80 sites determined to contain baseline levels of histone methylation. These handpicked sites were in regions that were clearly mappable, but also had other characteristic marks of low histone methylation, such as proximity to genes and low DNA methylation.

Zn Finger Constructs

The peptide containing 6 Zn fingers was designed as described in Segal et al (Segal et al., 2003) and cloned into pUC57 with Xho I sites at both ends (Genewiz). This Xho I fragment was excised and inserted into the unique Xho I site located in between the BLRP peptide and the HA tag in the pENTR-SUVH2 construct (Johnson et al., 2008), which encodes an HA-tagged SUVH2 driven by the endogenous SUVH2 promoter. This ZF-SUVH2 was then recombined into JP726 (Johnson et al., 2008) and introduced into fwa-4 using *agrobacterium*-mediated transformation. Transformed lines were selected for with BASTA.

Flowering Time

The flowering time of plants grown under short-day conditions was determined by counting all rosette and cauline leaves up until the terminal flower. The average leaf number of between 20-30 plants was determined.

Protein Preparation

The N-terminal truncated SUVH9 (residues 134-650) was cloned into a pFastBacHT B vector (Invitrogen), which fuses a hexa-histidine tag followed by a TEV cleavage site to the N-terminus of target gene. The plasmid was transformed into *E. coli* strain DH10Bac (Invitrogen) to generate bacmid. Baculovirus was generated by transfecting Sf9 cells with the bacmid following standard Bac-to-Bac protocol (Invitrogen). The harvested virus was subsequently used to infect the suspended Hi5 cell for recombinant protein expression. The recombinant protein was first purified using nickel affinity chromatography column (GE Healthcare). The hexa-histidine tag was cleaved by TEV protease. The target protein was further purified using a Q sepharose column and a Superdex G200 gel filtration column (GE Healthcare). The purified protein was concentrated to 15 mg/ml and stored at −80° C.

Crystallization

Before crystal screening, the SUVH9 protein was mixed with the putative cofactor S-adenosyl-L-homocysteine (SAH) in a molar ratio of 1:3 or with SAH and a histone H3(1-15) peptide in a molar ratio of 1:3:3 at 4° C. for 2 hours. Crystallization of the SUVH9 was carried out at 20° C. using the hanging drop vapor diffusion method by mixing 1 μl protein sample at a concentration of 11.5 mg/ml and 1 μl reservoir solution and equilibrating against 500 μl reservoir solution. SUVH9 was crystallized in the condition of 0.2 M potassium thiocyanate, 0.1M Bis-Tris propane pH 7.5, and 20% PEG 3350 in free form, as well as in the presence of SAH or in the presence of SAH and H3(1-15) peptide. Square-shaped crystals appeared in 2 weeks. All the crystals were dipped into reservoir solution supplemented with 15% glycerol and flash cooled into liquid nitrogen for diffraction data collection. The diffraction data were collected at beamline X29A, National Synchrotron Light Source (NSLS) at Brookhaven National Laboratory (BNL), New York at the zinc peak wavelength. The data were indexed, integrated, and further scaled with the program HKL2000 (Otwinowski and Minor, 1997).

Structure Determination and Refinement

The structure of SUVH9 in the free state was solved using single-wavelength anomalous dispersion method implemented in the program Phenix (Adams et al., 2010). The model building was carried out using the program Coot (Emsley et al., 2010) and structural refinement using the program Phenix (Adams et al., 2010). Throughout the refinement, a free R factor was calculated using 5% random chosen reflections. The stereochemistry of the structural models were analyzed using the program Procheck (Laskowski et al., 1993). The data are indicative that crystals of SUVH9 in presence of SAH and in the presence of SAH and H3(1-15) peptide are indeed the crystal of free form SUVH9. All the molecular graphics were generated with the program Pymol (DeLano Scientific LLC).

Results

Figure 5:
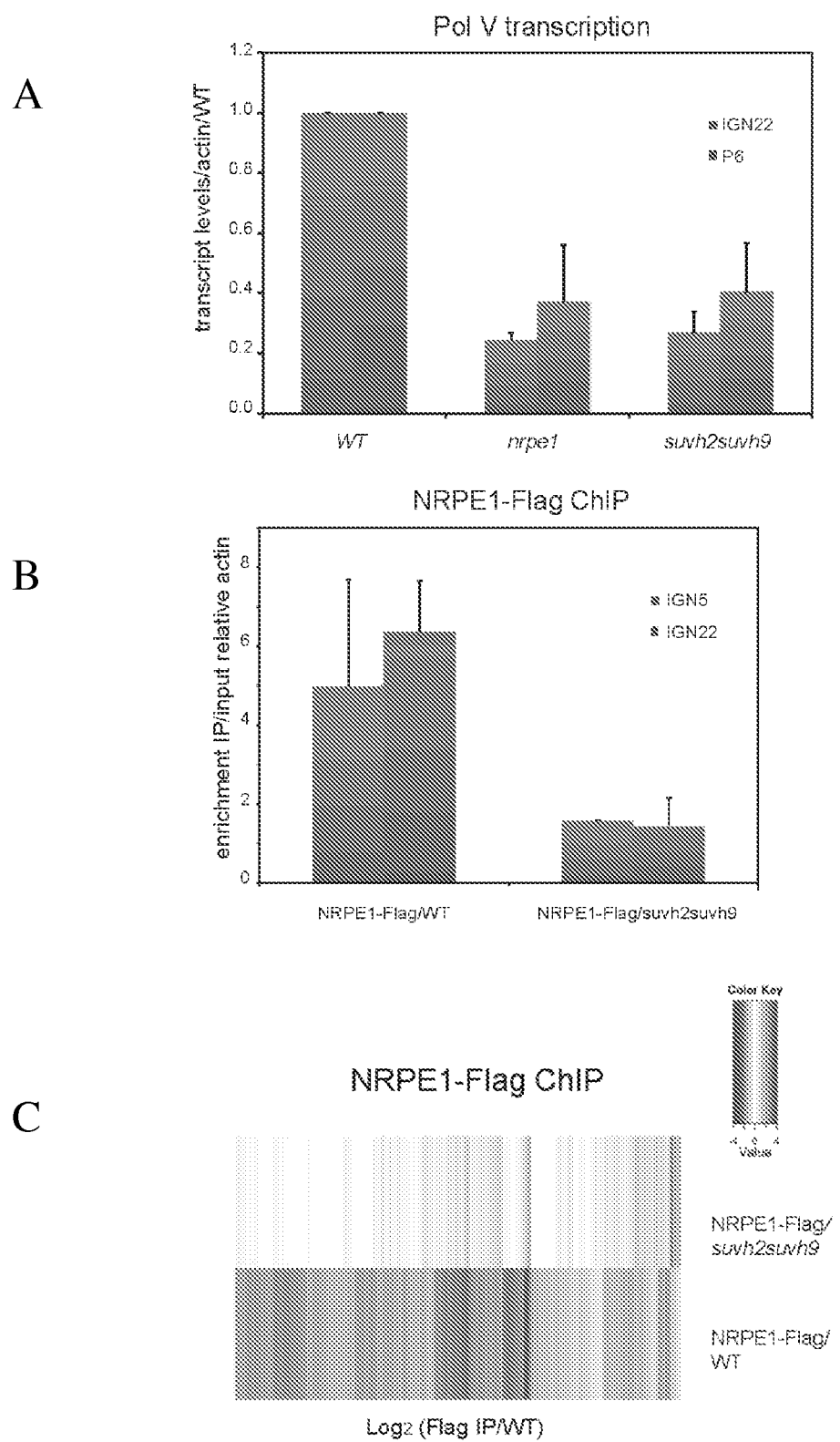
FIG. 5A-FIG. 5F illustrate that SUVH2 and SUVH9 are required for Pol V chromatin binding, transcription, and resulting DNA methylation.
Figure 5:
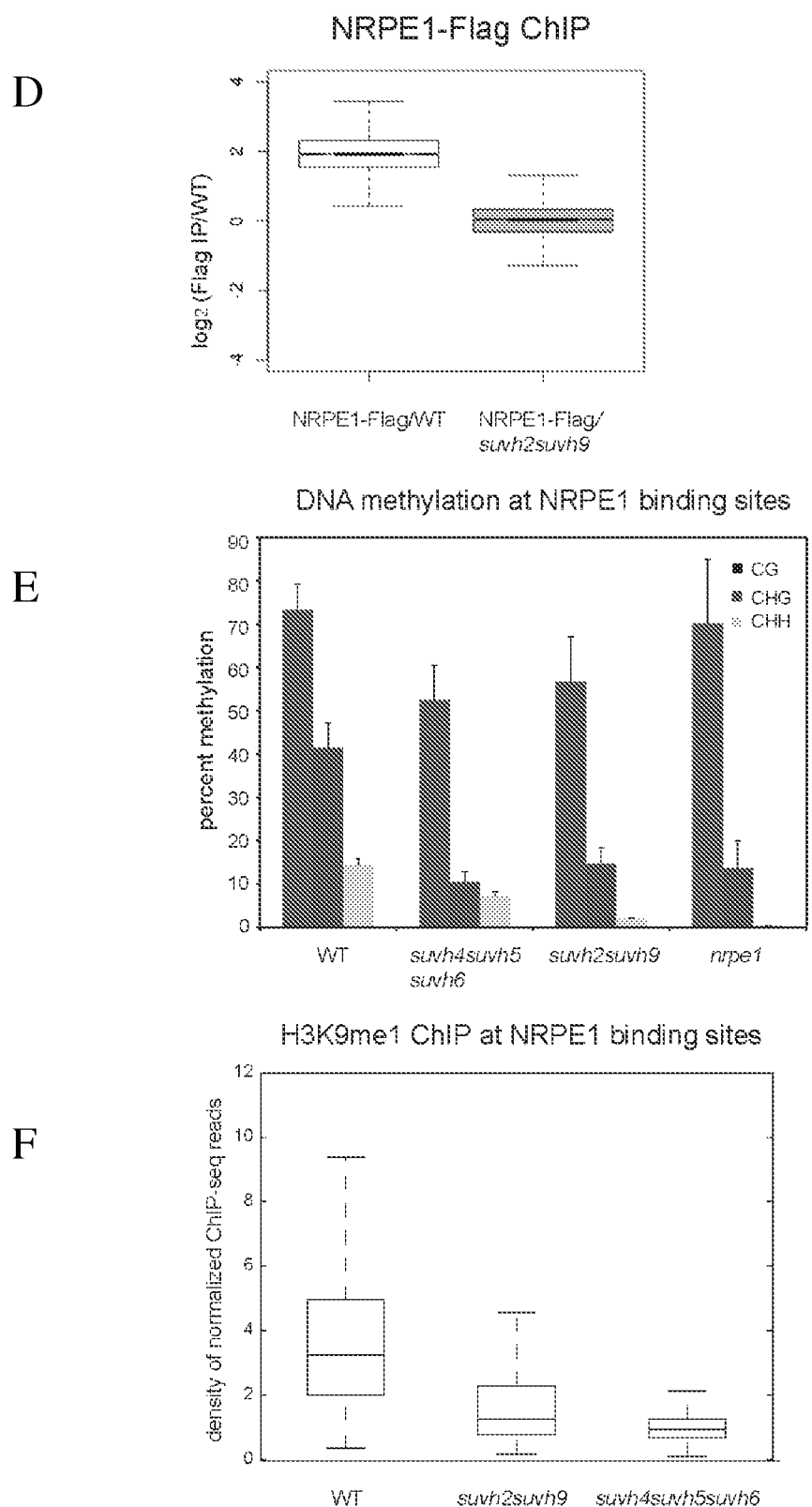

The synthesis of non-coding RNAs by Pol V is important to the downstream step in RdDM. To determine whether SUVH2/SUVH9 act before or after the synthesis of these transcripts, Pol V transcription was assayed at several characterized sites (IGN22 and P6 shown in FIG. 5A) (Wierzbicki et al., 2008; Zhong et al., 2012). It was found that the double mutant suvh2 suvh9 reduced Pol V transcripts to the same extent as the Pol V mutant, nrpe1 (FIG. 5A). These results suggest that SUVH2/SUVH9 are required either for Pol V activity or its recruitment to chromatin. Using chromatin immunoprecipitations (ChIPs) of a Flag-tagged Pol V, it was observed that only background levels of Pol V binding were found at IGN5 and IGN22 in the suvh2 suvh9 double mutant compared to a 6-fold enrichment in wild type (FIG. 5B). ChIP data was further analyzed by next generation sequencing (ChIP-seq) and it was found that binding of Pol V at all previously identified sites (Zhong et al., 2012) was significantly decreased in a suvh2 suvh9 background (FIG. 5C, 5D). Therefore, SUVH2 and SUVH9 are required not only for Pol V activity, but also for its stable association with chromatin.

To determine the level of DNA methylation at the Pol V binding sites in various mutants, whole-genome bisulfite sequencing was performed. It was found that a suvh2 suvh9 mutant line reduced CHH methylation by 85%, which was close to the reduction in methylation measured in the nrpe1 mutant line (FIG. 5E). These same mutant lines reduced CHG methylation by more than 50% underscoring that the RdDM pathway is also partly responsible for CHG methylation (Law and Jacobsen, 2010). These results demonstrate that RNA-directed DNA methylation at Pol V sites genome-wide is dependent upon SUVH2 and SUVH9. It was found that the methylation at Pol V sites was also partially dependent on the SUVH4/SUVH5/SUVH6/CMT3 pathway, since the suvh4 suvh5 suvh6 triple mutant reduced CHG methylation at Pol V sites by approximately 75% (FIG. 5E; similar reductions were observed with a cmt3 mutant).

As SUVH2/SUVH9 are in the same family of SET proteins as SUVH4/SUVH5/SUVH6, histone H3K9 methylation genome-wide by ChIP-seq was analyzed using antibodies specific for H3K9me1 and H3K9me2. A high correlation between non-CG DNA methylation and both H3K9me1 and H3K9me2 was observed. The double mutant suvh2 suvh9 did not significantly affect the levels of either H3K9me1 or H3K9me2 genome-wide, while the triple mutant suvh4 suvh5 suvh6 had a significant reduction in both H3K9me1 and H3K9me2. Both H3K9me1 and H3K9me2 over Pol V binding sites were mapped and it was found that both are enriched relative to the genome average, though H3K9me1 was found at higher levels than H3K9me2. H3K9me1 was reduced in suvh4 suvh5 suvh6 triple mutant plants to background levels at all Pol V sites, while the suvh2 suvh9 double mutant resulted in significant losses of histone methylation (FIG. 5F). H3K9me2 was not significantly changed in any of the mutants.

Without wishing to be bound by theory, it is believed that while the losses observed in the suvh2 suvh9 double mutant may be direct, but several lines of evidence support that these decreases in histone methylation are a secondary consequence of reduced DNA methylation. First, at some sites, H3K9me1 is part of a larger patch of heterochromatin and unaffected by suvh2 suvh9 while at others both DNA methylation and H3K9me1 is lost. Furthermore, a third class of sites was found with no detectable H3K9me1, but which had SUVH2/SUVH9 dependent DNA methylation. Second, a similar decrease of histone methylation was observed at these same sites in another RdDM mutant, rdr2. Thus it is likely that SUVH2/SUVH9 function to recruit Pol V resulting in RdDM, which then recruits the active histone methyltransferases SUVH4, SUVH5 and SUVH6. These enzymes bind methylated DNA through their SRA domains and methylate the associated histones. Without wishing to be bound by theory, it is believed that it is most likely that the losses of H3K9 methylation in suvh2 suvh9 double mutants is an indirect consequence of the loss of RNA directed DNA methylation.

To test directly whether the action of SUVH2/SUVH9 may be sufficient to target RNA-directed DNA methylation, a specific zinc finger (ZF) to tether SUVH2 to an unmethylated epiallele of FWA, fwa-4 (fwa-4 is the unmethylated FWA epiallele in Columbia, fwa-1 is the unmethylated epiallele in the *Landsberg erecta* ecotype) was engineered. The FWA gene encodes a homeodomain transcription factor that is normally silenced due to DNA methylation in its promoter (Soppe et al., 2000). The FWA epiallele has lost all DNA methylation, leading to ectopic expression of FWA and a heritable late flowering (Kakutani, 1997; Soppe et al., 2000). siRNAs normally involved in targeting DNA methylation still exist in the FWA epiallele but seem unable to direct downstream factors to methylate the promoter (Chan et al., 2006). Without wishing to be bound by theory, it is believed that in one model that although siRNAs are present, the Pol V scaffold transcript it missing. The FWA promoter region contains two small direct repeats followed by two larger repeats (Kinoshita et al., 2007). A peptide containing six ZFs was designed to recognize a sequence found in each of two small repeats (CGGAAAGATGTATGGCT) (SEQ ID NO: 141) (Kolb et al., 2005; Segal et al., 2003). The coding region for this peptide was then inserted into a HA-tagged SUVH2 transgene driven by the endogenous SUVH2 promoter (ZF-SUVH2) and introduced into an fwa-4 line using *Agrobacterium*-mediated transformation (FIG. 6A).

In T1 plants, approximately 75% of the ZF-SUVH2 transformants flowered early as compared to the parental fwa-4 line. Transformants of the control HA-tagged SUVH2 (HA-SUVH2) line that did not contain the Zn finger flowered at the same time as the fwa-4 parent, showing that the effect was specific to the ZF-SUVH2 fusion. T1 plants containing either the ZF-SUVH2 or HA-SUVH2 were carried out to the T2 generation and flowering time was determined (FIG. 6A, 6B). The line containing ZF-SUVH2 flowered just slightly later than the Columbia (WT) control, whereas HA-SUVH2 without a Zn finger flowered at about the same time as the fwa-4 parent. These results suggest that ZF-SUVH2 is in fact being targeted to the FWA promoter and causing transcriptional repression.

DNA methylation in the FWA promoter region was analyzed using bisulfite sequencing. In the wild-type line a large region of DNA methylation is detected, with particularly high levels of CG methylation (FIG. 6D). In fwa-4, this region was completely devoid of DNA methylation. In three independent T1 lines containing the ZF-SUVH2 in fwa-4, a methylation profile that was distinct from WT was observed. DNA methylation was at a high level immediately around the Zn finger binding sites in all three sequence contexts. DNA methylation then tapered off over the downstream transcribed region (FIG. 6E). In the control HA-SUVH2 T1 plants, no DNA methylation was observed at FWA. These results indicate that targeting SUVH2 to FWA with the ZF is sufficient to induce DNA methylation and gene silencing.

Figure 7:
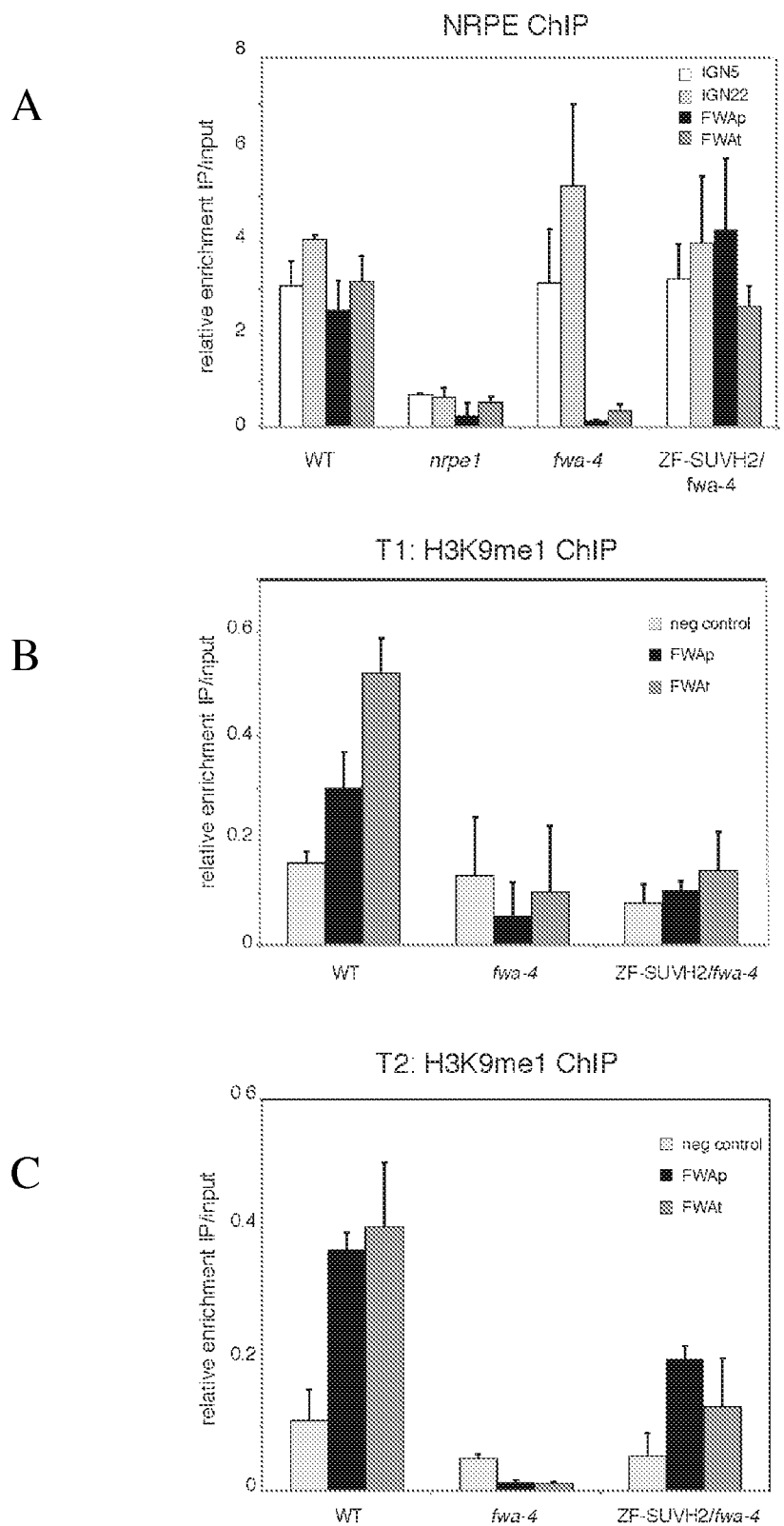
FIG. 7A-FIG. 7C illustrate that ZF-SUVH2 recruits Pol V, but not histone methylation, to FWA.

To determine whether Pol V was present at FWA in the fwa-4 epimutant, endogenous antibodies to NRPE1 were used in ChIP experiments of wild type, nrpe1 and fwa-4 lines. Enrichment of Pol V at two known Pol V sites, IGN5 and IGN22, was observed in the wild type and fwa-4 lines, but not in nrpe1 mutant plants (FIG. 7A). When the FWA locus was examined, enrichment in the wild type at both the promoter and transcript regions was observed, but not in nrpe1 or fwa-4 (FIG. 7A). Thus, Pol V is present at the FWA locus when it is in its DNA methylated and silent state in the wild type, but not when it is in an unmethylated state in the fwa-4 epiallele. To determine if binding of the ZF-SUVH2 to the FWA promoter recruits Pol V, NRPE1 ChIP in a T2 line containing ZF-SUVH2 in fwa-4 was performed. Unlike the parental fwa-4 line, in the presence of ZF-SUVH2, an enrichment of Pol V at FWA was observed (FIG. 7A), indicating that ZF-SUVH2 targeting acted to recruit or stabilize Pol V at FWA.

The histone methylation status of FWA in the different lines was also assayed. In the wild-type line, a slight enrichment of H3K9me1 in the FWA promoter region and a 4-fold enrichment in the FWA transcript region was observed (FIG. 7B). In the fwa-4 line, no enrichment was observed. No enrichment of H3K9me1 in early flowering ZF-SUVH2/fwa-4 T1 plants was detected (FIG. 7B). However, in the next generation from these plants (T2), a slight enrichment of H3K9me1 was observed, slightly stronger over the promoter region than the transcript region (FIG. 7C). These results suggest that although ZF-SUVH2 recruits Pol V and DNA methylation immediately in the first generation, histone methylation is not immediately restored, but accumulates after the plants are inbred for an additional generation.

Figure 8:
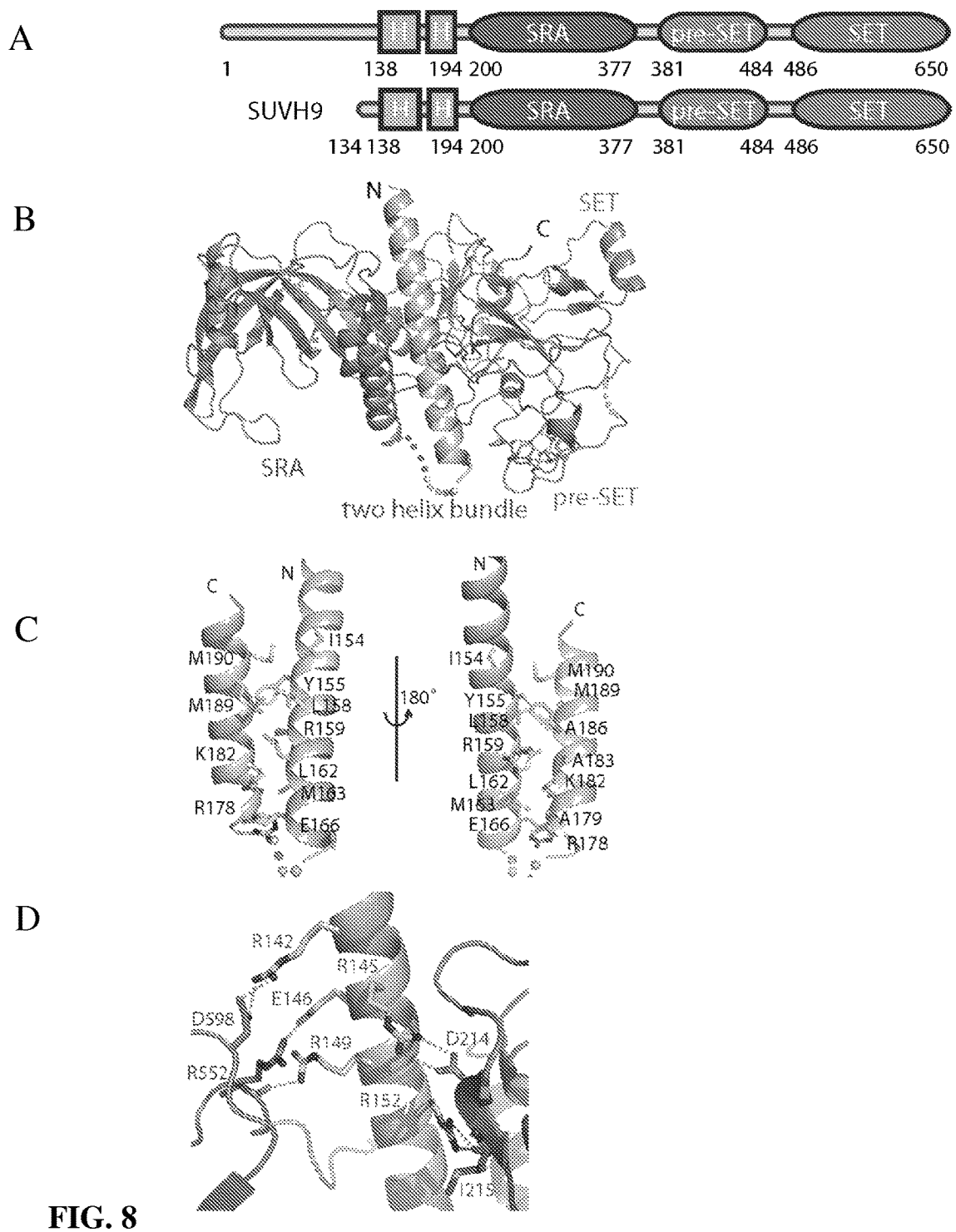
FIG. 8A-FIG. 8H illustrate the crystal structure of SUVH9 in the free state and interactions between domains.
Figure 8:
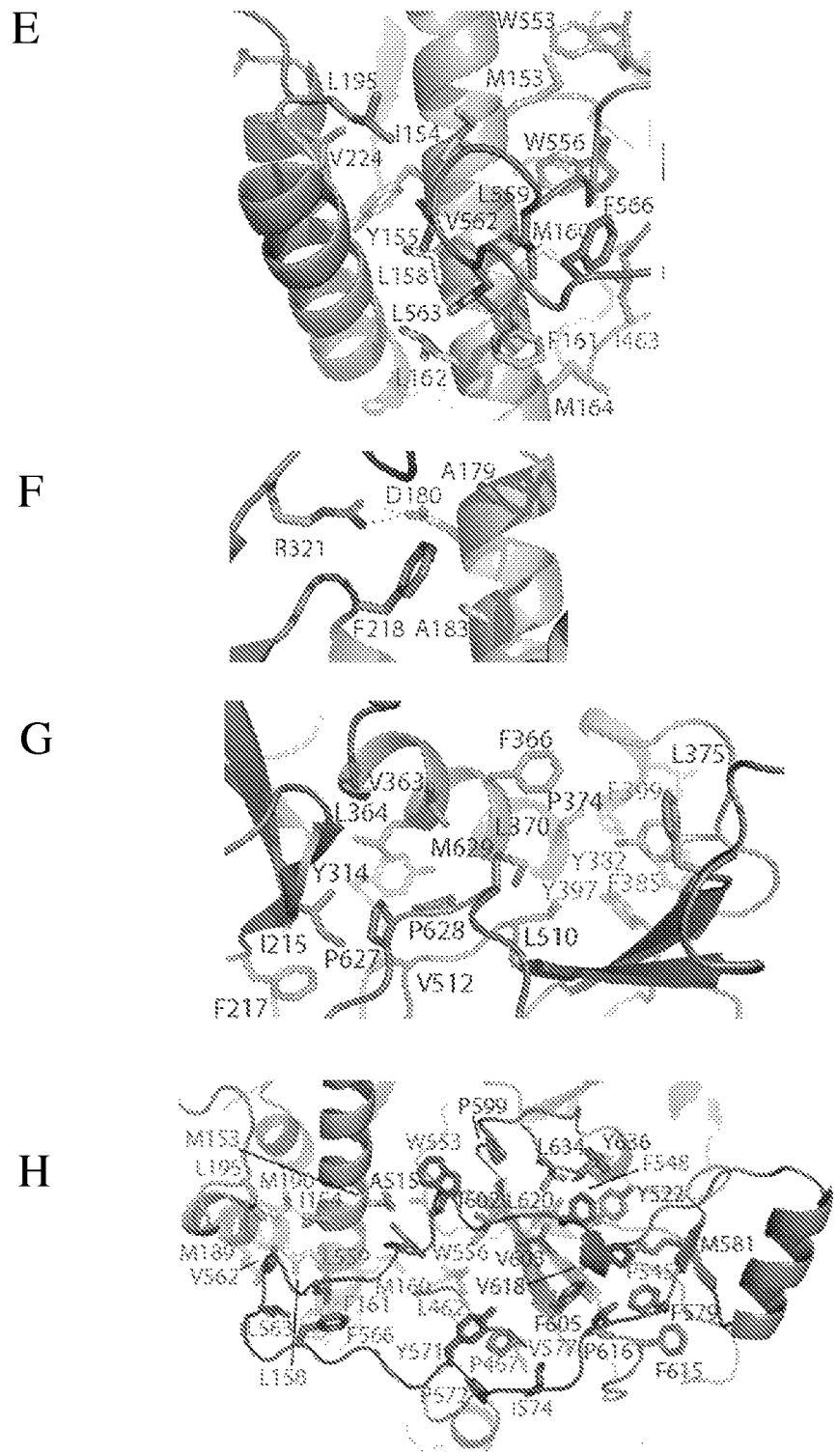

To gain additional insights into the function of SUVH2/SUVH9 a structural analysis of both proteins was performed. Through protein crystallization, the structure of an N-terminally-truncated SUVH9 construct (residues 134-650) that represents the first structural view of the *Arabidopsis* SUVH family SRA-SET cassette-containing proteins was solved. The first 130 residues of SUVH9 are predicted to be disordered and without homology to any known domains, while the remaining residues contain all the known functional domains of SUVH9 (the SRA, pre-SET, and SET domains) (FIG. 8A). The structure of SUVH9 was determined using the single-wavelength anomalous dispersion method and refined to 2.4 Å resolution with an R factor of 18.7% and an R free of 22.3% (FIG. 8B). The structure of SUVH9 is composed of three segments: a two-helix bundle towards the N-terminus (residues 138-194), the SRA domain (residues 195-379), and the pre-SET/SET domains (residues 380-637) (FIG. 8B).

A unique feature of the SUVH9 structure is the formation and location of a two-helix bundle towards the N-terminus, which is sandwiched between the SRA domain and the pre-SET/SET domains, thereby interacting with both of them. The interface between the two α-helices is enriched with hydrophobic residues, which participate in extensive van der Waals interactions, supplemented by salt bridge formation following insertion of Glu166 of the longer first helix between Arg178 and Lys182 of the shorter second helix (FIG. 8C). These hydrophobic interactions and salt bridges stabilize the relative position of the two helices, and serve as a scaffold for anchoring of the SRA domain and pre-SET/SET domains on either side of the two-helix bundle, thereby resulting in the formation of an overall rigid topology for the entire protein.

The two-helix bundle is deeply buried at the interface of the SRA domain and pre-SET/SET domains, whose relative alignments are stabilized through formation of extensive hydrophobic and hydrophilic interactions. The longer first helix (residues 138-169) of the two-helix bundle inserts into the interface between the SRA and the pre-SET/SET domains. The N-terminal segment of the longer helix is very hydrophilic and makes several pairs of salt bridges and hydrogen bonds with surrounding residues (FIG. 8D). By contrast, the C-terminal part of this helix contains a large and continuously hydrophobic surface that interacts with both the shorter second helix (FIG. 8C) and other domains of the protein (FIG. 8E). A long loop extends out from the SET domain (FIG. 8E) and covers the outer surface of the longer helix. The tip of this loop contains several hydrophobic residues (Leu559, Val562, and Leu563) that form extensive van der Waals interactions with hydrophobic residues (Ile154, Leu158, Phe161, and Leu162) on one face of the longer helix. Without wishing to be bound by theory, it is believed that the longer helical segment might play an important role in the stabilization of the overall architecture of the SUVH9 protein. The shorter second helix mainly interacts with the C-terminal part of the longer helix (FIG. 8B, 8C), supplemented by few hydrogen bonding and hydrophobic interactions with the SRA domain (FIG. 8F).

The SRA domain of SUVH9 resembles the reported structures of SRA domains from UHRF1 and SUVH5 (Arita et al., 2008; Avvakumov et al., 2008; Hashimoto et al., 2008; Rajakumara et al., 2011). The superposition of SUVH9 and SUVH5 SRA domains yields an RMSD of 1.2 Å for 145 aligned Cα atoms, consistent with almost identical folding of the two proteins, whose core elements are composed of a six-stranded twisted β-barrel and two α-helices. Unlike the observed disordered loop in SUVH5 SRA domain, the C-terminus of the SUVH9 SRA domain forms an α-helix, that is followed by a short turn and then directly links to the pre-SET domain.

The relative orientation between the SRA and pre-SET/SET domains is stabilized by extensive direct interactions between them and through interactions with the two-helix bundle. The direct interaction between the SRA domain and the pre-SET/SET domains are mainly dominated by hydrophobic interactions (FIG. 8G). In particular, the C-terminal extended α-helix of the SRA domain uses a hydrophobic surface to interact with a continuous hydrophobic surface of the pre-SET/SET domains, with residues flanking the α-helix of the SRA domain also contributing to the formation of the hydrophobic interface. The structure of the pre-SET/SET domains of SUVH9 is similar to the published structures of H3K9 histone methyltransferases, such as Dim5, G9a, and GLP (Wu et al., 2010; Zhang et al., 2002; Zhang et al., 2003). Superposition of the pre-SET/SET domains of SUVH9 and human H3K9 methyltransferase GLP yields an RMSD of 1.8 Å for 252 aligned Cα atomS, although they only share a sequence identity of 34%. As commonly observed in other SET domain proteins, nine conserved Cys residues of the pre-SET domain of SUVH9 coordinate three $Zn^{2+}$ ions to form an equilateral triangle cluster (FIG. 8B).

Figure 9:
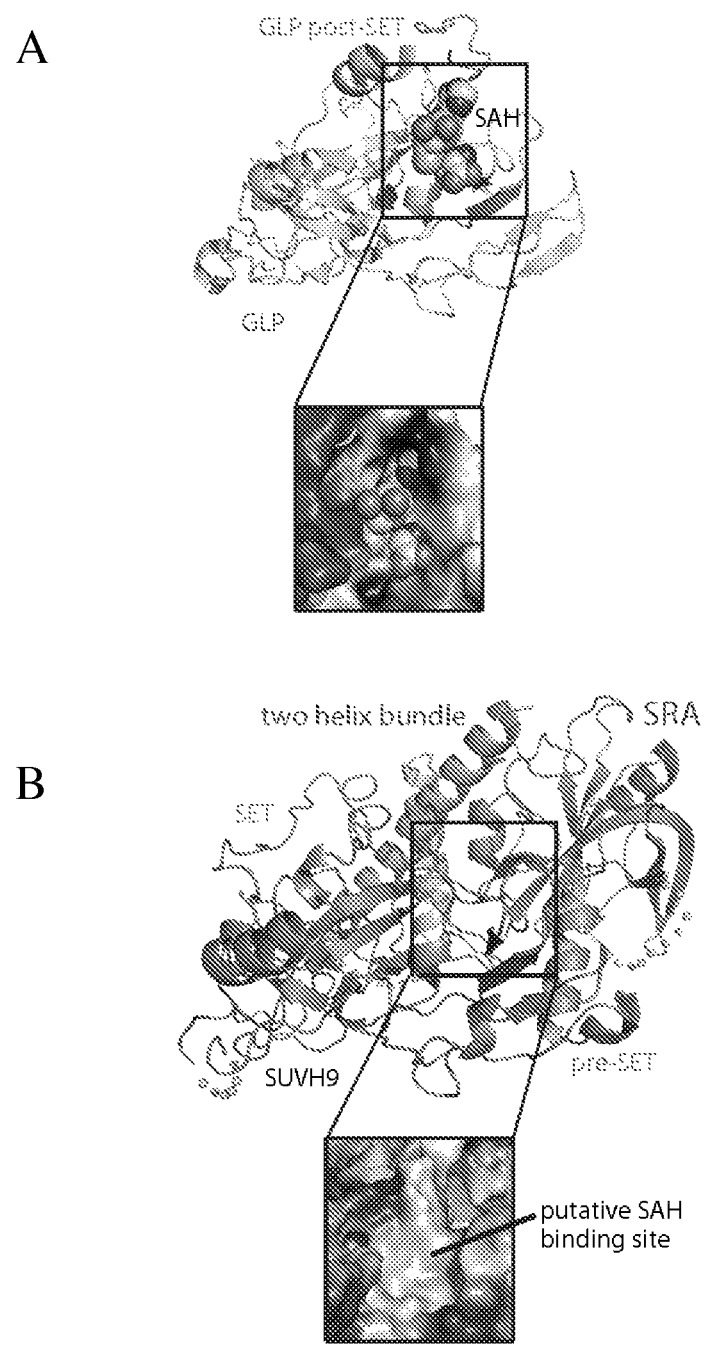
FIG. 9A-FIG. 9E illustrate the structural comparison of SAH- and peptide-bound GLP and SUVH9 in the free state and structural basis underlying lack of methyltransferase activity for SUVH9.
Figure 9:
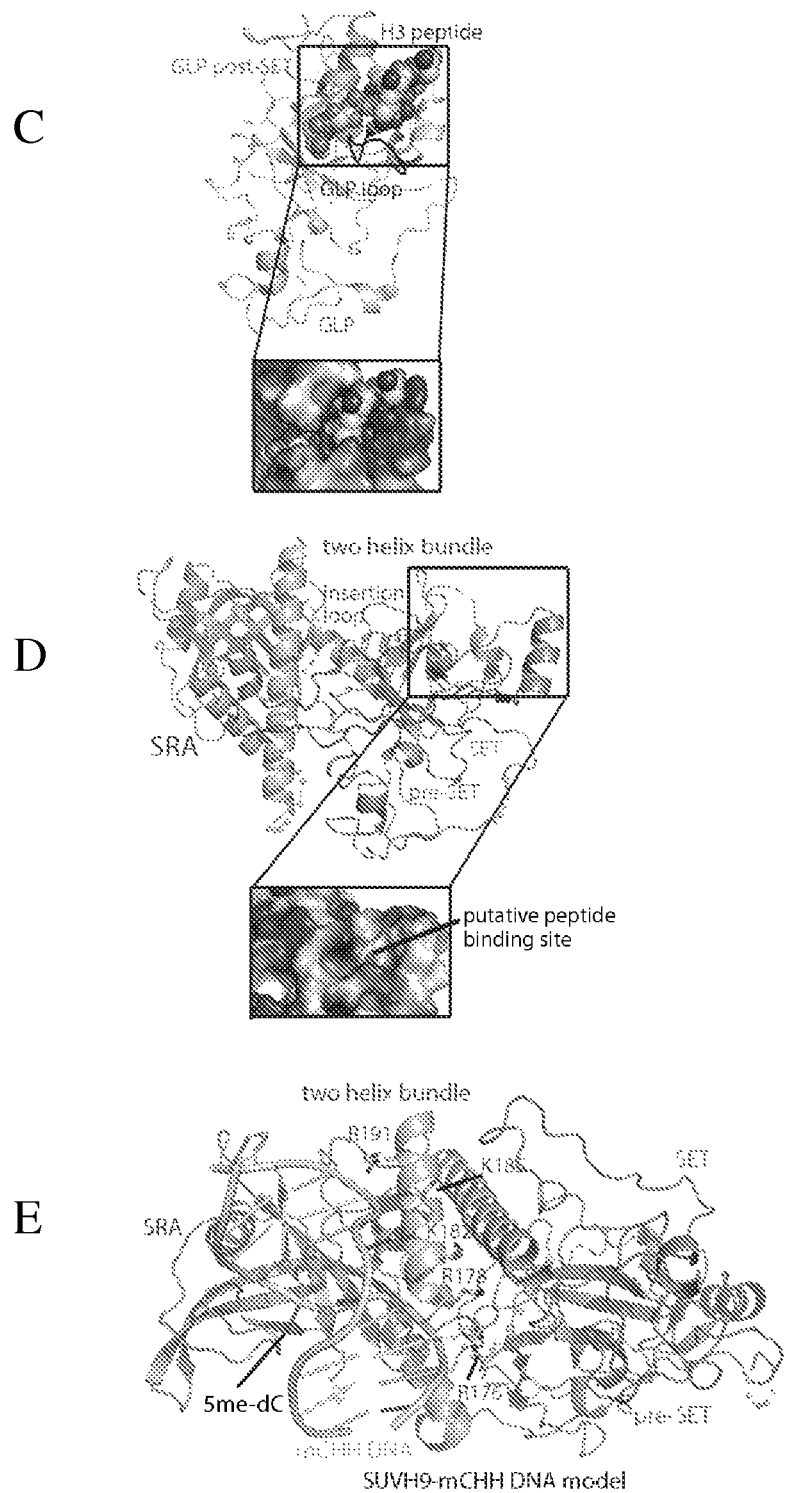

Although SUVH9 contains histone methyltransferase like pre-SET and SET domains, it exhibits neither detectable histone methyltransferase activity, nor binding capacity for SAM cofactor in vitro (Johnson et al., 2008). In the primary sequence, although SUVH9 retains two Tyr residues (Tyr522 and Tyr636, which correspond to Tyr1124 and Tyr1211 of human GLP, that contribute to methyltransferase activity (Wu et al., 2010; Zhang et al., 2002; Zhang et al., 2003), it lacks the post-SET domain, which is important for cofactor and peptide substrate binding, as well as catalysis. The pre-SET and SET domains of human GLP and SUVH9 adopt similar folding topologies (Wu et al., 2010). In human GLP, the SAH binding pocket is relatively narrow and exhibits pronounced structural and chemical complementarity for SAH (FIG. 9A). Moreover, the existence of a post-SET domain with the capacity to cover the adenine moiety of SAH acts to stabilize the binding of this cofactor molecule. By contrast, the putative SAH-binding pocket of SUVH9 is very open (FIG. 9B) and cannot retain a bound SAH molecule, especially in the absence of the stabilizing role of the post-SET domain. In addition, usually SUV family active methyltransferases utilize a Cys residue from the SET domain together with three Cys residues from the post-SET domain to coordinate a $Zn^{2+}$ ion to stabilize the relative position and conformation of the loop-enriched region of the post-SET domain. By contrast, the Cys residue is replaced by a Thr in the SET domain of SUVH9, so that even if a partner protein were to bring three Cys residues, it would still not be possible to form a $Zn^{2+}$ stabilized coordination center.

In SET domain-containing H3K9 methyltransferases, the peptide substrate is positioned between the SET and post-SET domains (FIG. 9C), and stabilized through formation of extensive main chain and side chain intermolecular interactions with the enzyme. In human H3K9 methyltransferase GLP, an acidic loop region (residues 1145-1153) of the SET domain is involved in the recognition of the peptide substrate (FIG. 9C). By contrast, the corresponding segment in SUHV9 contains an insertion loop of 25 residues, enriched with hydrophobic residues (FIG. 8H). The insertion loop adopts a well-defined topology because it is stabilized through formation of extensive hydrophobic interactions with residues from the SET and pre-SET domains (FIG. 8H), especially the tip of the loop, which covers and interacts extensively with the two-helix bundle (FIG. 8H). An examination of the SUVH9 structure identifies the potential for steric clash between the insertion loop and a putatively bound peptide substrate, thereby preventing access of the peptide substrate into the peptide-binding cleft of the SUVH9 protein (FIG. 9D).

This Example demonstrates that SUVH2 and SUVH9 are required for the recruitment of Pol V to regions containing DNA methylation. Furthermore, a ZF-SUVH2 fusion was used to show that SUVH2 targeting is sufficient for recruitment of Pol V and DNA methylation to an unmethylated target gene. Without wising to be bound by theory, it is believed that the mechanism of action of SUVH2 and SUVH9 provides a reinforcing loop between pre-existing DNA methylation and further rounds of RNA-directed DNA methylation.

Example 3

The following Example relates to the production and characterization of a modified *A. thaliana* SHH1 protein that is engineered to contain a nucleic acid binding domain to target the modified SHH1 protein to a specific nucleic acid sequence. In this example the targeting of SHH1 to the promoter regions of the APETALA1 locus was associated with the enrichment of siRNAs at APETALA1.

Materials and Methods

Construction of TAL-SHH1

The Gateway entry clone containing SHH1 including 1.4 kb of the promoter region and the ORF with C-terminal BLRP and 3×Myc tags was described previously (Law et al., 2011). BsaI recognition sites were removed from the SHH1 entry clone by site directed mutagenesis (Quickchange II, Agilent) using primers SHH1deltaBsaI_fo, 5'-GGGA-GAGTGAACGTTGGTGACCTGCTTCTATGTTT-3' (SEQ ID NO: 142), SHH1deltaBsaI_re and 5'-AAACATA-GAAGCAGGTCACCAACGTTCACTCTCCC-3' (SEQ ID NO: 143). After removing the BsaI sites the entry clone was linearized by restriction digestions with XhoI. In order to insert the DNA sequence encoding a modified Hax3-based transcription activator-like effector (TALE) (Sanjana et al., 2012) excluding the C-terminal nuclear localization signal and acidic activation domain flanked by GSSGSS linkers in frame in between the C-terminal BLRP and 3×Myc tags of SHH1, 2.8 kb of the TALE backbone including the ccdB selection cassette were amplified from TALE transcriptional activator (TALE-TF) plasmid (Addgene) using primers TALETFintotag_fo, 5'-CCAAGGACCTCTC-GAGGGATCTTCAGGTTCATCTTCGCGGACCCG-GCTCCCT-3' (SEQ ID NO: 144) and TALETFintoSHH1Myc_re, 5'-CATAGATCCCTCGAGT-GAAGAACCAGATGATCCGCTAGCTGACGCGCGA-3' (SEQ ID NO: 145). The amplification product was fused with the linearized entry clone using In-Fusion HD cloning system (Clontech). The TALE DNA-binding domain targeting the sequence 5'-TTAGGATTTGCGTGTCGAC-3' (SEQ ID NO: 146) corresponding to chromosome 1 from nucleotide positions 25986363 to 25986381 in the promoter region of APETALA1 (AT1G69120) was assembled from 18 monomer-repeats (Addgene) by Golden Gate cloning and inserted between the BsaI sites flanking the ccdB selection cassette (Sanjana et al., 2012). The DNA sequence encoding the TALE target repeats is listed (SEQ ID NO: 140). In order to facilitate binding of the TAL-SHH1 fusion protein to methylated cytosine the repeat variable "diresidue" (RVD) N* was used (Valton et al., 2012). Plasmids encoding monomer RVDs N* and NH were generated by site-directed mutagenesis (Quickchange II, Agilent) of the TALE monomer template plasmid pNN_v2 (Addgene) using primers NN>N*_fo, 5'-GTGGCAATTGCGAG-CAACGGGGGAAAGCAG-3' (SEQ ID NO: 147), NN>N*_re, 5'-CTGCTTTCCCCCGTTGCTCGCAATT-GCCAC-3' (SEQ ID NO: 148), NN>NH_fo, 5'-GGCAAT-TGCGAGCAACCATGGGGGAAAGCAGGCAC-3' (SEQ ID NO: 149) and NN>NH_re, 5'-GTGCCTGCTTTC-CCCCATGGTTGCTCGCAATTGCC-3' (SEQ ID NO: 150), respectively. TALE-TF plasmid encoding RVD N* was generated by site-directed mutagenesis (Quickchange II, Agilent) of pTALE-TF_v2 (NN) (Addgene) using primers TALETF_NN>N*_fo, 5'-TGGCTATTGCATC-CAACGGGGGCAGACC-3' (SEQ ID NO: 151) and TALETF_NN>N*_re, 5'-GGTCTGCCCCCGTTGGATG-CAATAGCCA-3' (SEQ ID NO: 152). Binary vector was generated using LR clonase II (Life Technologies) and modified pEarlyGate302 destination vectors containing the hph selection marker (Law et al., 2011).

Plant Material

TAL-SHH1 constructs were transformed into shh1 (SALK_074540) of ecotype Col-0 by *Agrobacterium tumefaciens* strain ABL0 using the floral dip method (Clough and Bent, 1998). T1 plants were selected with Hygromycin B and expression of the chimeric TAL-SHH1 proteins was tested by protein isolation and Western blot with antibodies against the 3×Myc, respectively. T1 plants showing strong transgene expression were selected.

Results

Figure 18:
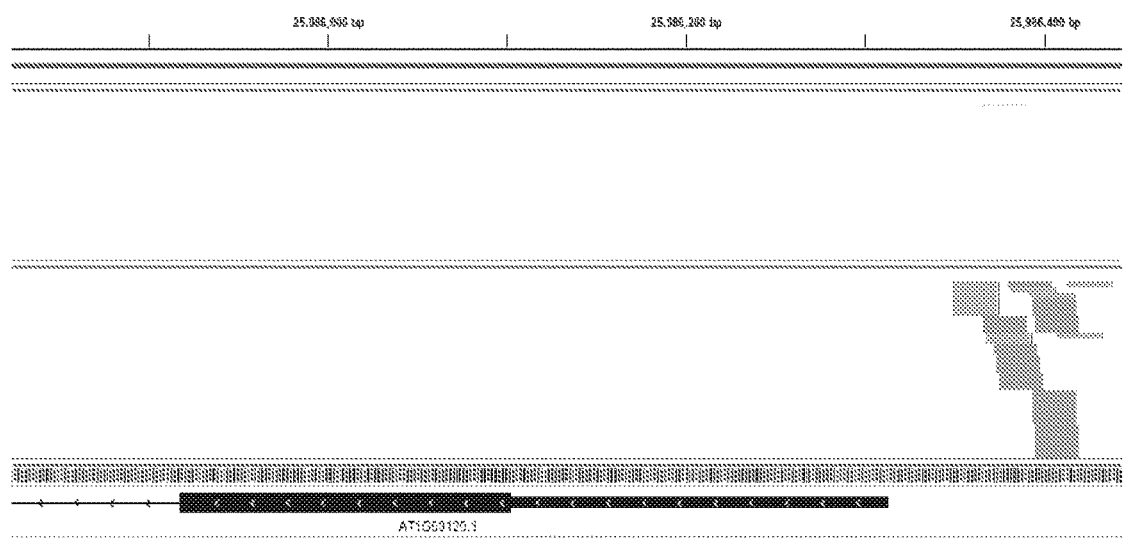
FIG. 18 illustrates small RNAs present at the APETALA1 (At1g69120) promoter region in wild type plants (top half) or the TAL-SHH1 containing plants (bottom half). SiRNAs on the top strand are in red and siRNAs on the bottom strand are in blue.

After selecting a plant containing the TAL-SHH1 directed against the APETALA1 gene, small RNA libraries were generated and deeply sequenced using established protocols (Law et al., 2013) to detect the presence of small RNAs produced at the APETALA1 gene in response to targeting SHH1 to the promoter. As a control, small RNAs were sequenced from a wild type plant, which would not be predicted to contain siRNAs present in the promoter region of APETALA1. As shown in FIG. 18, small RNAs were detected corresponding to both strands of the DNA in the TAL-SHH1 plants but not the wild type plants, indicating that the modified SHH1 protein could target small RNAs to the AP1 promoter.

Example 4

The following Example highlights the relationship between DNA methylation and Pol V binding via SUVH2/SUVH9 and demonstrates that SUVH2 interacts with DRD1.

Materials and Methods

Experimental Procedures in *Arabidopsis*

Chromatin immunoprecipitations (ChIPs) were performed as in Bernatavichute et al. (2008), except that ground tissue was crosslinked with formaldehyde in the following buffer: 10 mM HEPES pH 8.0, 1 M Sucrose, 5 mM KCl, 5 mM MgCl2, 5 mM EDTA, and 0.6% Triton X-100. All primers used are listed in Table 12 below. Libraries for NRPE1 ChIP-Seq were generated using the Ovation Ultralow DR Multiplex System (NuGen). Bisulfite sequencing followed by PCR amplification and cloning of FWA fragments was done using EZ DNA Methylation-Gold kit (Zymo Research) as performed in Johnson et al. (2008). BS-Seq libraries were generated as described in Example 1, and all libraries were sequenced using the HiSeq 2000 platform following manufacturer instructions (Illumina) at a length of 50 bp. Zinc finger constructs were generated as described in Example 2.

TABLE 12

List of Primers

| | Primer numbers | Primer sequences from 5' to 3' |
|---|---|---|
| Actin | JP2699 | AGCACGGATCGAATCACATA (SEQ ID NO: 153) |
| | JP2700 | CTCGCTGCTTCTCGAATCTT (SEQ ID NO: 154) |
| IGN22 | JP9978 | CGGGTCCTTGGACTCCTGAT (SEQ ID NO: 155) |
| | JP9979 | TCGTGACCGGAATAATTAAATGG (SEQ ID NO: 156) |
| P6 | JP10059 | GGCTTCGATAGGAAGAATGCCC (SEQ ID NO: 157) |
| | JP10060 | GTGAAACTGCCAGATCCAAATTC (SEQ ID NO: 158) |
| IGN5 | JP6606 | TCCCGAGAAGAGTAGAACAAATGCTAAAA (SEQ ID NO: 159) |
| | JP6607 | CTGAGGTATTCCATAGCCCCTGATCC (SEQ ID NO: 160) |

TABLE 12-continued

List of Primers

| Primer numbers | Primer sequences from 5' to 3' |
|---|---|
| Ta3 | |
| JP2456 | TGGAATCTCAGGGTCAAGG (SEQ ID NO: 161) |
| JP2457 | CCTTCTGAGGTGAGGGACA (SEQ ID NO: 162) |
| FWAp | |
| JP7717 | AAGAGTTATGGGCCGAAGC (SEQ ID NO: 163) |
| JP7718 | CGCTCGTATGAATGTTGAATG (SEQ ID NO: 164) |
| FWAt | |
| JP6747 | ATAAAGAGCGGCGCAAGAT (SEQ ID NO: 165) |
| JP6748 | CGCTCTAGGGTTTTTGCTTT (SEQ ID NO: 166) |
| Neg control JP3034 | AGGCCCCATCTCACAAATAC (SEQ ID NO: 167) |
| Neg control JP3035 | GTCGCCAGGTAGATTTGGTT (SEQ ID NO: 168) |

Data Analysis

Bisulfite-Seq (BS-Seq) reads were aligned to the TAIR10 version of the *Arabidopsis thaliana* reference genome using BS-seeker. For BS-Seq up to 2 mismatches were allowed and only uniquely mapped reads were used.

Co-Immunoprecipitation Experiments

*Nicotiana benthamiana* was infiltrated with pLJ322 (ZF-HA-SUVH2 in JP7468) and leaves were collected after 3 days. Leaves that were not infiltrated were used as a negative control. 3 g of tissue was ground in liquid N2 and resuspended in 12 ml of IP buffer (50 mM Tris pH 8.0, 150 mM NaCl, 5 mM MgCl2, 10% glycerol, and 0.1% NP40) with 1 µg/ml pepstatin, 1 mM PMSF, and 1× complete protease inhibitor tab-EDTA (Roche). The extracts were filtered through miracloth and centrifuged for 5 min at 3,000 g. 200 µl HA-magnetic beads (MRL) were added and rotated at 4° C. for 45 min. After 3 washes with IP buffer, these were then incubated with DRD1-Flag *Arabidopsis* flower extracts made in the same fashion. Incubation continued for 45 min rotating at 4° C. The beads were washed 3 times with IP buffer and boiled in 60 µl SDS dyes. Western blots were probed with either anti-Flag-HRP or anti-HA-HRP antibodies. The co-IP experiment in *Arabidopsis* was performed starting with 2 g of flowers from plants expressing HA-SUVH2, Flag-DRD1 or T2 plants containing both HA-SUVH2 and Flag-DRD1. Extracts were made as described above and 100 µl of Flag-magnetic beads (Sigma) were added and incubated with rotation at 4° C. for 45 min. Washes and western blots were performed as described above.

Results

Figure 11:
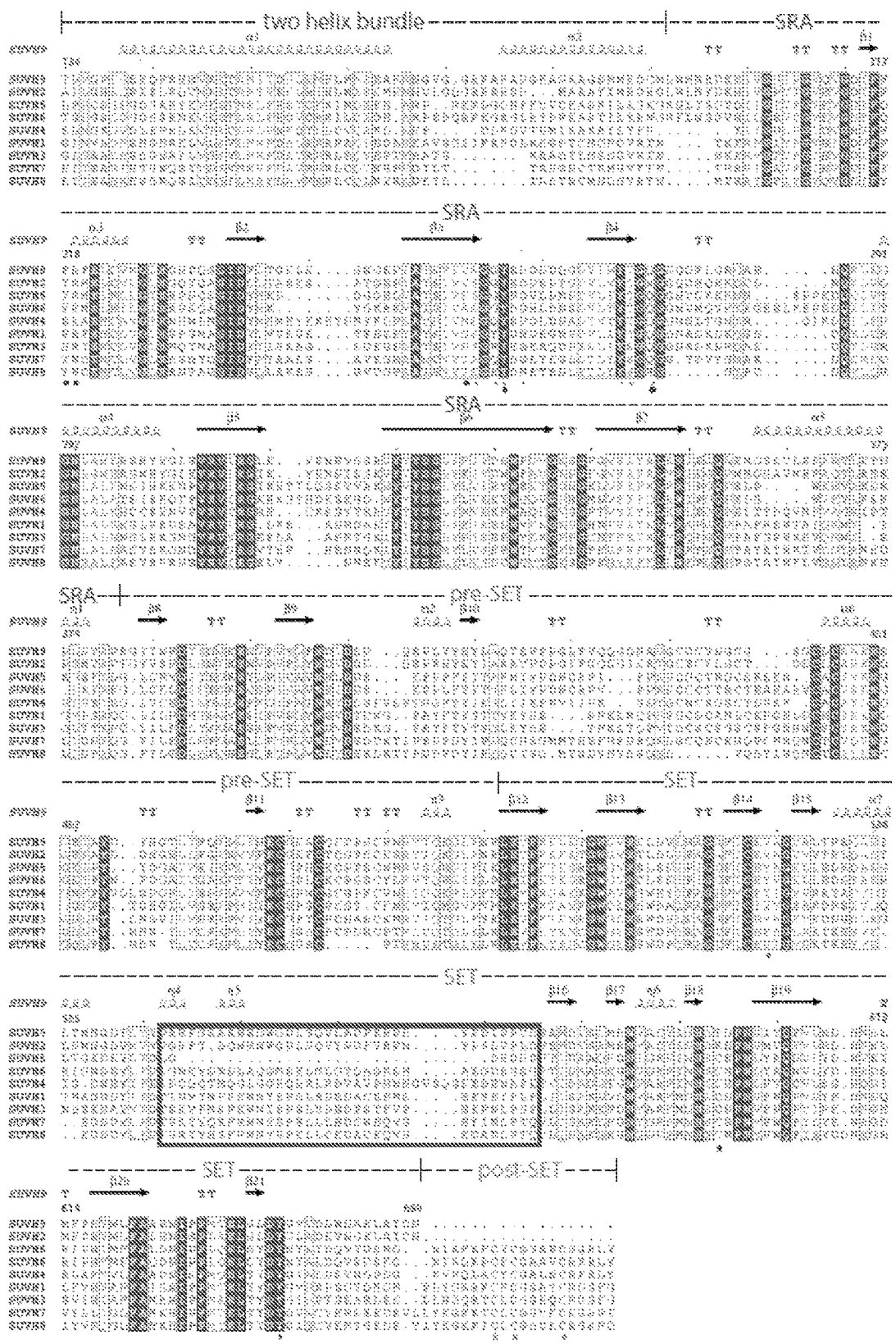
FIG. 11 illustrates structure-based sequence alignment of SUVH family proteins from *Arabidopsis*. The secondary structural elements of SUVH9 are labeled on the top of the sequence alignment. The domain boundaries are marked on the top. Conserved residues involved in the interaction with flipped 5mC base and the DNA backbone available from the published SUVH5-DNA complex structures are highlighted with cyan circles and blue hexagons, respectively. The insertions in the SET domains are highlighted with a purple box. The zinc-coordinating Cys residues are highlighted with black stars in the SET domain and grey stars in the post-SET domain. Two-tyrosine residues that are conserved and normally important for enzymatic activity are highlighted with red dots. Proteins shown are SUVH9 (SEQ ID NO: 27), SUVH2 (SEQ ID NO: 14), SUVH5 (SEQ ID NO: 178), SUVH6 (SEQ ID NO: 179), SUVH4 (SEQ ID NO: 180), SUVH1 (SEQ ID NO: 181), SUVH3 (SEQ ID NO: 182), SUVH7 (SEQ ID NO: 183), and SUVH8 (SEQ ID NO: 184).

The results presented in Example 2 illustrate how a SUVH protein fused to DNA-binding domain motifs can be targeted to an unmethylated target gene and recruit Pol V and DNA methylation to the unmethylated target gene. Sequences alignments of various SUVH proteins are presented in FIG. 11. Example 2 also establishes that SUVH2 and SUVH9 are required not only for Pol V activity, but also for its stable association with chromatin throughout the genome.

Figure 12:
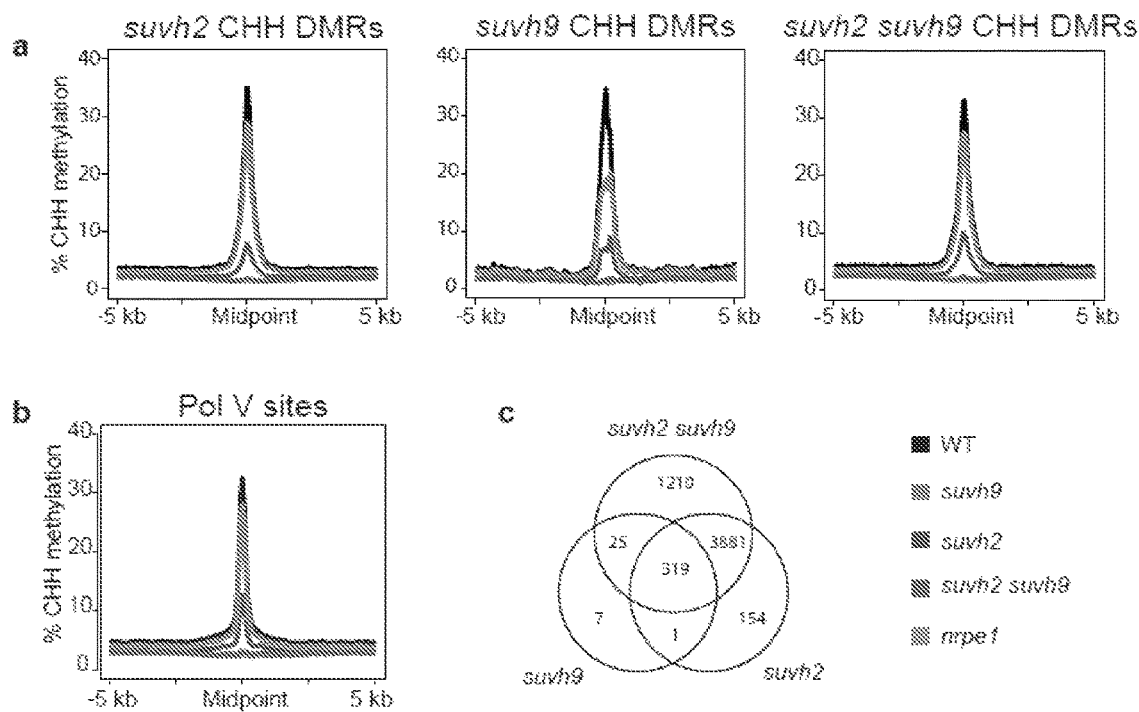
FIG. 12A-FIG. 12C illustrate that SUVH2 and SUVH9 act redundantly genome-wide.

To determine the effect of SUVH2 and SUVH9 on DNA methylation at defined Pol V binding sites, whole-genome bisulfite sequencing (BS-Seq) was utilized, as seen in Example 2. BS-Seq results of the single mutants suvh2 and suvh9 was also analyzed to determine if SUVH2/SUVH9 act redundantly at all sites or have non-overlapping sites where they function. It was found that suvh2 had a stronger effect than suvh9 at Pol V sites as well as at differentially methylated regions (DMRs) defined in either suvh2 or suvh9 single mutants, or in the suvh2 suvh9 double mutant (FIG. 12). These results indicate that SUVH2 and SUVH9 act redundantly throughout the genome to control RNA-directed DNA methylation.

Figure 13:
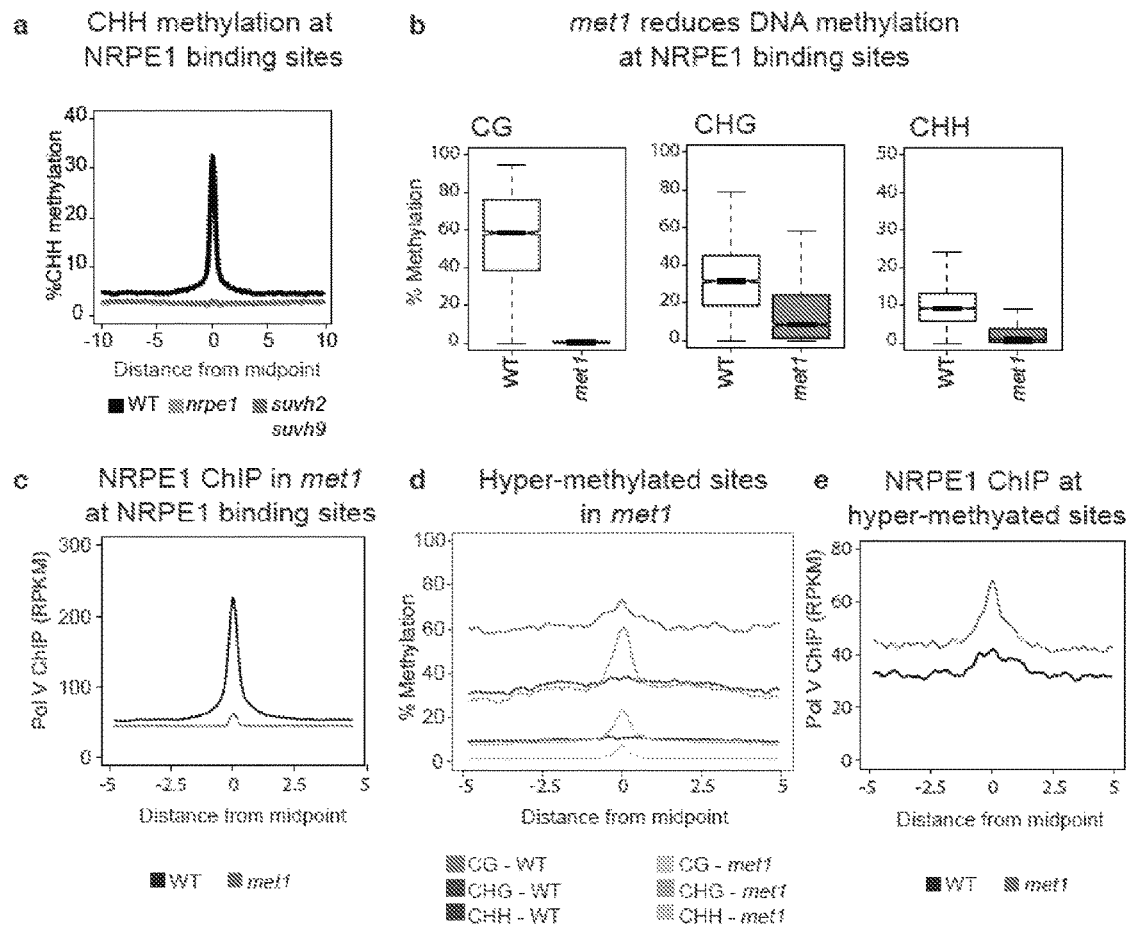
FIG. 13A-FIG. 13E illustrate that Pol V binding is dependent on DNA methylation.

Without wishing to be bound by theory, the results presented in Example 2 also suggest that a reinforcing loop exists between DNA methylation and Pol V binding via SUVH2/SUVH9. To further investigate this, a mutation in the maintenance methyltransferase MET1 that eliminates CG methylation genome-wide and also reduces CHG and CHH methylation (Aufsatz et al., 2004; Stroud et al., 2013; Lister et al., 2008) was utilized (FIG. 13B). Using endogenous antibodies to NRPE1, ChIP-seq revealed that Pol V occupancy was virtually eliminated in met1 compared to wild type at sites normally occupied by Pol V (FIG. 13C). In contrast, at a series of sites previously identified as gaining methylation in met1 (Stroud et al., 2013), an increase in Pol V binding was observed (FIG. 13D and FIG. 13E). These results suggest that DNA methylation is an important component of Pol V recruitment. Point mutations in the SRA domains of both SUVH2 and SUVH9 were shown to cause a loss of RNA-directed DNA methylation, indicating that the SRA domains contribute to function (Johnson et al., 2008). Together, and without wishing to be bound by theory, these results suggest that SUVH2/SUVH9 binding to methylated DNA recruits Pol V, thus providing a link between preexisting DNA methylation and the recruitment of further methylation by the RdDM pathway.

Figure 15:
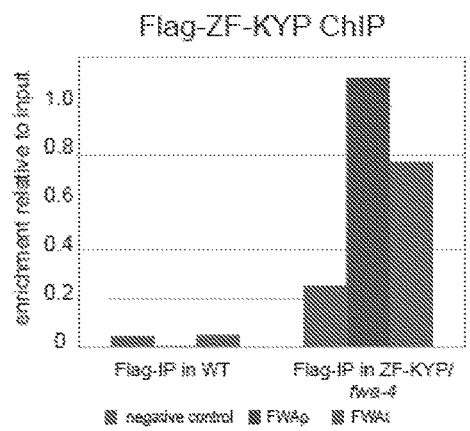
FIG. 15A-FIG. 15C illustrate that the ZF-SUVH2 construct stably recruits Pol V to FWA through a direct interaction with DRD1.
Figure 15:
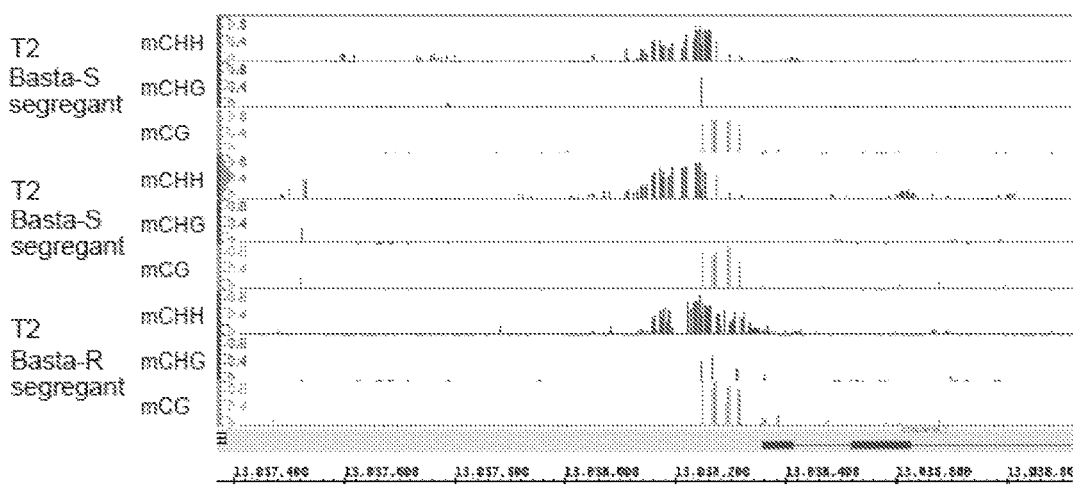
Figure 15:
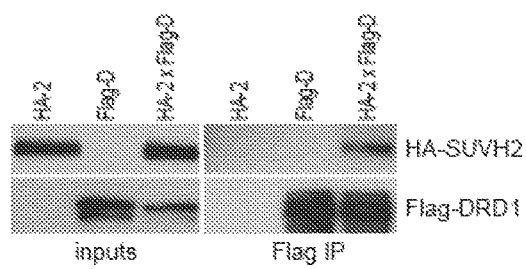

It was further found that a KYP protein fused to a zinc finger targeting FWA in an fwa-4 background (ZF-KYP/fwa-4) flowered with similar timing to the fwa-4 mutant (late flowering compared to wild-type), in contrast to the results observed for ZF-SUVH2/fwa-4 plant lines. ZF-KYP was included as an additional negative control because KYP (also known as SUVH4), is a SUVH protein not required for RdDM. The presence of the control ZF-KYP at FWA was also shown by ChIP (FIG. 15A).

Figure 6:
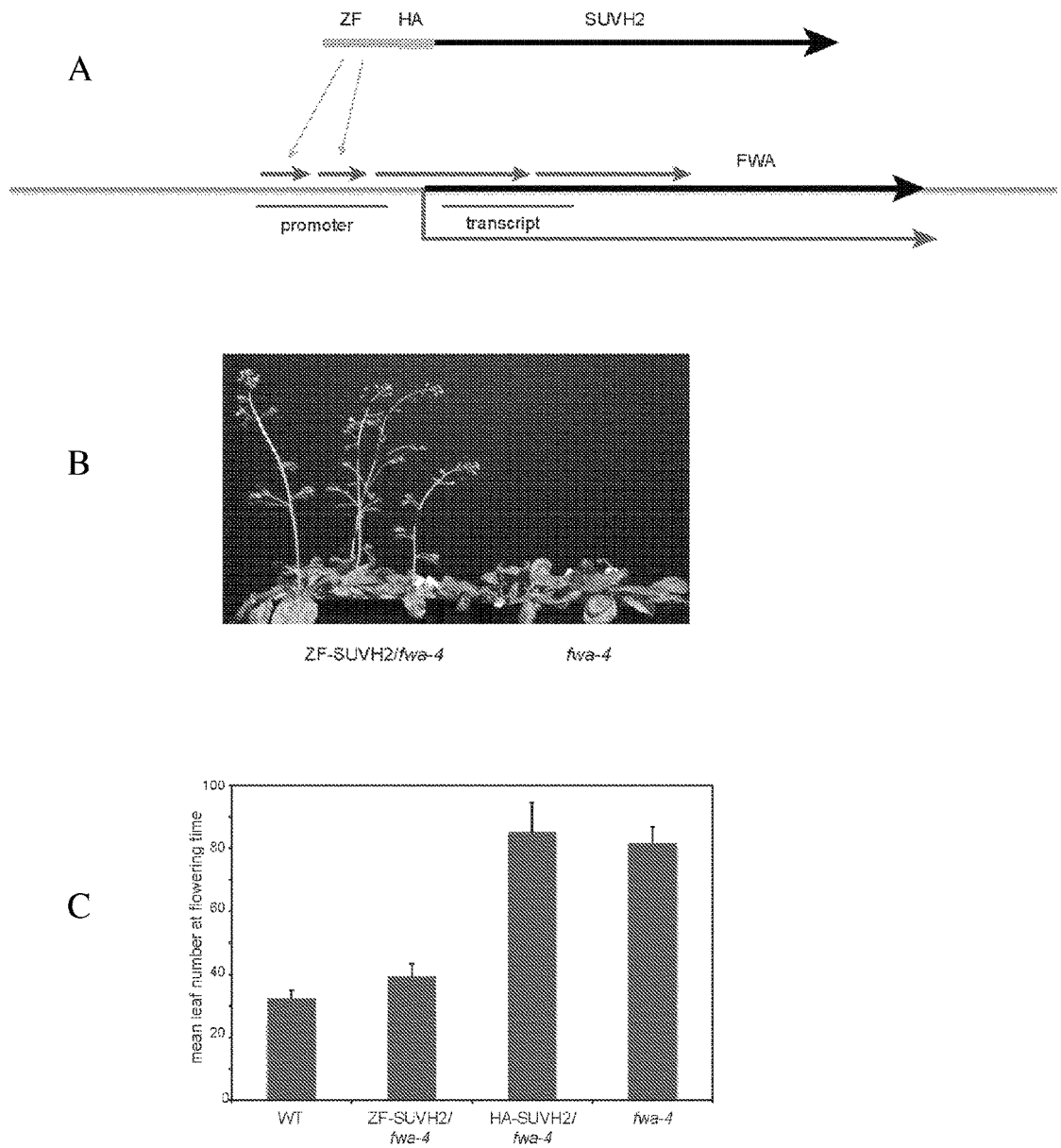
FIG. 6A-FIG. 6E illustrate that tethered SUVH2 attracts DNA methylation and causes late-flowering phenotype.
Figure 6:
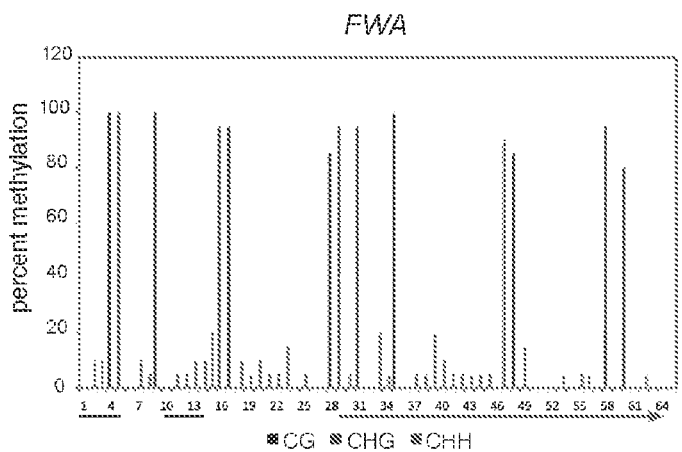
Figure 6:
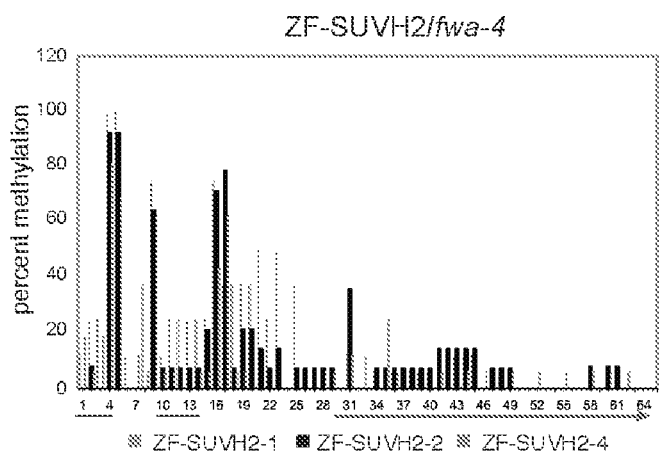
Figure 14:
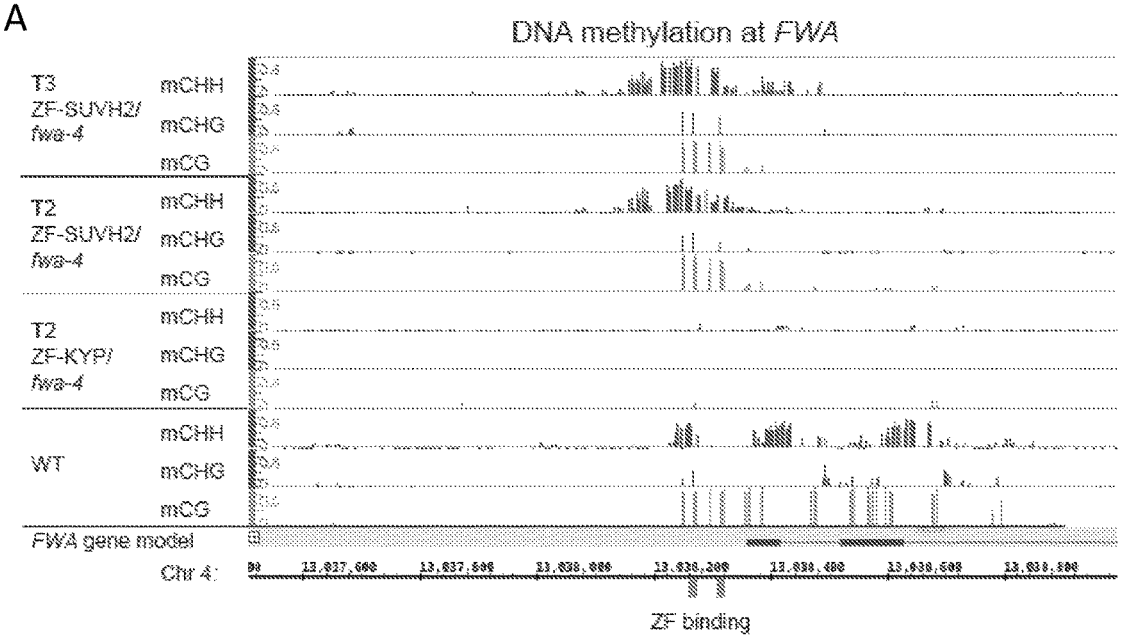
FIG. 14A-FIG. 14B illustrate that tethered SUVH2 recruits Pol V through DRD1, resulting in DNA methylation and a late-flowering phenotype.
Figure 14:
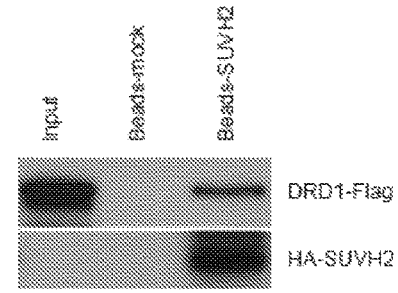

To further investigate this targeting, using the plant lines as described in FIG. 6 from Example 2, bisulfite sequencing was used to determine if FWA gene silencing was associated with DNA methylation. In the wild-type line a large region of DNA methylation is detected, with particularly high levels of CG methylation (FIG. 14A). In both fwa-4 and transformants with ZF-KYP or HA-SUVH2, this region was completely devoid of DNA methylation (see ZF-KYP; FIG. 14A). In three independent T1 lines analyzed containing the ZF-SUVH2 in fwa-4, DNA methylation at a high level immediately around the Zn finger binding sites in all cytosine sequence contexts was observed, which then tapered off over the downstream transcribed region (Example 2, FIG. 6E). One of the lines was followed (ZF-SUVH2-2) out to the T2 and T3 generations, and BS-seq was used to determine the extent of methylation spreading (FIG. 14A). It was found that methylation extended approximately 150 base pairs in either direction from the binding sites and did not expand significantly between generations. It was also observed that this DNA methylation and silencing was maintained in T2 segregants that had lost the ZF-SUVH2 transgene (FIG. 15B). These results indicate that targeting SUVH2 to FWA is sufficient to induce DNA methylation and gene silencing, and that this epigenetic silent state can be maintained in the absence of ZF-SUVH2.

From Example 2, experiments were designed to test whether the ZF-SUVH2 was recruiting Pol V. NRPE1 ChIP was used to examine the levels of Pol V at FWA in wild-type, nrpe1, and fwa-4 lines. Enrichment of Pol V at two known Pol V sites, IGN5 and IGN22, in the wild-type and fwa-4 lines, but not in nrpe1 mutant plants was observed (FIG. 7A). At FWA, enrichment of Pol V in the wild type at both the promoter and transcript regions, but not in nrpe1 or fwa-4 was observed (FIG. 7A). Thus, Pol V is present at FWA in its DNA methylated and silent state in the wild type, but not in its unmethylated state in the fwa-4 epiallele. To determine if binding of the ZF-SUVH2 to FWA recruits Pol V, NRPE1 ChIP was performed in a T2 line containing ZF-SUVH2 in fwa-4. Unlike the parental fwa-4 line, the ZF-SUVH2 line showed enrichment of Pol V at FWA (FIG. 7A). Together, these results indicate that SUVH2 is sufficient to localize Pol V at the FWA promoter, leading to DNA methylation and gene silencing.

In order to address the potential mechanism by which SUVH2 or SUVH9 target RdDM, mass spectrometry datasets generated by immunoprecipitating protein complexes utilizing various epitope-tagged RdDM factors were queried. Although SUVH2/9 peptides in several IP-mass spectrometry studies from purification of Pol V (utilizing NRPE1-Flag) have not been observed, SUVH2 peptides in two independent mass spectrometric datasets for DRD1 (FIG. 16) were identified. DRD1 is a component of the DDR complex (also containing DMS3 and RDM1) which interacts with Pol V (Law et al., 2010) and is required for Pol V occupancy throughout the genome (Zhong et al., 2012). The number of SUVH2 peptides observed was lower than those from the DMS3 and RDM1 proteins which are stoichiometric components of the DDR complex, and also lower than the level of peptides of most Pol V complex components, suggesting that the interaction between SUVH2 and DRD1 is weaker or more transient than the interaction between the DDR components or between DDR and Pol V. To confirm the interaction between DRD1 and SUVH2, epitope-tagged SUVH2 was expressed in leaves of *Nicotiana benthamiana* and purified on HA magnetic beads. Using this as a source of SUVH2, DRD1-Flag was specifically and reproducibly pulled down from transgenic *Arabidopsis* protein extracts (FIG. 14B: beads-SUVH2). As a negative control, the same assay was performed using *N. benthamiana* that was not expressing tagged SUVH2, and DRD1-Flag could not be detected in this assay (FIG. 14B: beads-mock). In addition, co-immunoprecipitation experiments were performed with HA-tagged SUVH2 and Flag-tagged DRD1 in transgenic *Arabidopsis* plants and an interaction between these proteins was also observed (FIG. 15C). These results confirm the IP-mass spectrometry observations and, without wishing to be bound by theory, are consistent with a model in which SUVH2 acts indirectly via a transient interaction with DDR complex components including DRD1 to recruit Pol V.

Example 5

This Example demonstrates the targeting of different components of the RNA-directed DNA methylation pathway to recruit Pol V to specific loci.

Introduction

The RNA-directed DNA methylation (RdDM) pathway mediates de novo DNA methylation in plants. Examples 2 and 4 demonstrate the use of ZF-SUVH2 to specifically target methylation and silencing of a target locus. This was achieved by utilizing the FWA gene as a target. Expression of FWA causes a strong late-flowering phenotype in *Arabidopsis*. Methylation at the promoter of this gene, as is present in wild-type plants, causes transcriptional silencing of FWA and results in an early-flowering phenotype relative to fwa-4 mutants. The fwa-4 *Arabidopsis* epigenetic mutant shows no methylation in the promoter of the FWA gene and thus shows the characteristic late-flowering phenotype (relative to wild type). Examples 2 and 4 describe a chimeric SUVH2 protein fused to a Zinc Finger (ZF) protein designed to target the promoter of FWA in *Arabidopsis*, ZF108, and demonstrates that this fusion protein can promote methylation at this genomic site in fwa-4 plants. This methylation targeting is accompanied by the recruitment of Pol V to this (FWA) site and results in the production of the non-coding RNA needed to trigger methylation, gene silencing, and therefore produce an early-flowering phenotype.

Materials and Methods

Fusion Protein Construction

In order to create the different fusion proteins described in this example, the ZF108 fragment in the pUC57 plasmid described in Example 2 was digested with the restriction enzyme XhoI and inserted directly into the unique XhoI site in different genes, or inserted into a pCR2 plasmid containing either Flag-BLRP or HA-BLRP fusions that contain an XhoI site located in between the tag and BLRP and that are flanked by AscI restriction sites. Individual constructs were constructed as described below.

DRD1-HA-ZF: The HA-ZF108-BLRP fusion in the pCR2 plasmid was digested with AscI and inserted in the single AscI site of the pENTR-DRD1 plasmid (Law et al, 2010), located 6 base pairs after the end of the coding sequence of DRD1.

DMS3-Flag-ZF: The Flag-ZF108-BLRP fusion in the pCR2 plasmid was digested with AscI and inserted in the single AscI site of the pENTR-DMS3 plasmid (Law et al, 2010), located 6 base pairs after the end of the coding sequence of DMS3.

RDM1-Flag-ZF: For this purpose, the plasmid pENTR-RDM1 was created, which contains a genomic sequence of RDM1 including 350 base pairs of 5' promoter sequence. The Flag-ZF108-BLRP fusion in the pCR2 plasmid was then digested with AscI and inserted in the single AscI site of a pENTR-RDM1 plasmid, located 6 base pairs after the end of the coding sequence of RDM1.

RDM1-HA-ZF: For this purpose, the plasmid pENTR-RDM1 was created, which contains a genomic sequence of RDM1 including 350 base pairs of 5' promoter sequence. The HA-ZF108-BLRP fusion in the pCR2 plasmid was then digested with AscI and inserted in the single AscI site of a pENTR-RDM1 plasmid, located 6 base pairs after the end of the coding sequence of RDM1.

HA-ZF-DRM3: For this purpose, the plasmid pENTR-BLRP-HA-DRM3 was used, which contains a genomic sequence of DRM3 including 2500 base pairs of 5' promoter sequence and a BLRP-HA fusion right before the start codon. The ZF108 fragment in the pUC57 plasmid was then digested with XhoI and inserted in the single XhoI site of the pENTR-BLRP-HA-DRM3 plasmid, located between the BLRP and HA tag.

HA-2XZF-DRM3: For this purpose, the plasmid pENTR-BLRP-HA-DRM3 was used, which contains a genomic sequence of DRM3 including 2500 base pairs of 5' promoter sequence and a BLRP-HA fusion right before the start codon. The ZF108 fragment in the pUC57 plasmid was then digested with XhoI and two copies of ZF108 were inserted in tandem in the single XhoI site of the pENTR-BLRP-HA-DRM3 plasmid, located between the BLRP and HA tag.

ZF-3F9M-DRM2: A ZF108 fragment flanked by EcoRI sites in a pUC57 was digested with EcoRI and inserted in the single EcoRI site in the plasmid pENTR-3F9M-DRM2 (Henderson et al., 2010), located at the 5' start of the 3×Flag-9×Myc tag.

FRG-Flag-ZF: For this purpose, the plasmid pENTR-FRG was used that contains a genomic sequence of FRG including 800 base pairs of 5' promoter sequence. The Flag-ZF108-BLRP fusion in the pCR2 plasmid was digested with AscI and inserted in the single AscI site of the pENTR-FRG plasmid, located 6 base pairs after the end of the coding sequence of FRG.

SUVR2-Flag-ZF: The plasmid pENTR-SUVR2 was used that contains a genomic sequence of SUVR2 including 2000 base pairs of 5' promoter sequence. The Flag-ZF108-BLRP fusion in the pCR2 plasmid was digested with AscI and inserted in the single AscI site of a pENTR-SUVR2 plasmid, located 6 base pairs after the end of the coding sequence of SUVR2.

SUVR2-HA-ZF: The plasmid pENTR-SUVR2 was used, that contains a genomic sequence of SUVR2 including 2000 base pairs of 5' promoter sequence. The HA-ZF108-BLRP fusion in the pCR2 plasmid was digested with AscI and inserted in the single AscI site of a pENTR-SUVR2 plasmid, located 6 base pairs after the end of the coding sequence of SUVR2.

MORC6-HA-ZF: The plasmid pENTR-MORC6 was uded, that contains a genomic sequence of MORC6 including 2463 base pairs of 5' promoter sequence. The HA-ZF108-BLRP fusion in the pCR2 plasmid was digested with AscI and inserted in the single AscI site of a pENTR-MORC6 plasmid, located 6 base pairs after the end of the coding sequence of MORC6.

Flag-ZF-CMT2: The plasmid pENTR-Flag-CMT2 was generated, which contains a genomic sequence of CMT2 including 1032 base pairs of 5' promoter sequence and a BLRP-Flag fusion right before the start codon. The ZF108 fragment in the pUC57 plasmid was digested with XhoI and inserted in the single XhoI site of the pENTR-BLRP-Flag-CMT2 plasmid, located between the BLRP and Flag tag.

Introduction of Fusion Proteins into fwa-4

All ZN-108 fusion protein constructs described above were recombined into the vector JP726 and introduced into fwa-4 using *agrobacterium*-mediated transformation. Transformed lines were selected for with BASTA.

Results

To explore whether various other RdDM proteins have the ability to trigger de novo DNA methylation at the FWA locus in the fwa-4 mutant, a series of experiments were conducted in an attempt to target different components of the RdDM pathway to the promoter of the FWA gene in *Arabidopsis*. Various proteins involved in RdDM were selected and were fused to the ZF108 zinc finger, which targets the FWA promoter (see Example 2), and transformed into the fwa-4 mutant. ZF-targeting lines were constructed as described above, in a fashion analogous to those described in Examples 2 and 4. The flowering time of ~30 independent transgenic lines was scored. The list of the different RdDM components chosen and the flowering time results are shown below in Table 13.

TABLE 13

Early flowering in T1 lines compared to fwa-4

| Plant Line | Early flowering in T1 lines compared to fwa-4 |
| --- | --- |
| DRD1-HA-ZF | 0% |
| DMS3-Flag-ZF | 80% |
| RDM1-Flag-ZF | 0% |
| RDM1-HA-ZF | 0% |
| HA-2XZF-DRM3 | 0% |
| HA-ZF-DRM3 | 0% |
| ZF-3F9M-DRM2 | 0% |
| FRG-Flag-ZF | 0% |
| SUVR2-Flag-ZF | 10% |
| SUVR2-HA-ZF | 0% |
| MORC6-HA-ZF | 50% |
| Flag-ZF-CMT2 | 0% |

The results presented in Table 13 demonstrate that DMS3-ZF and MORC6-ZF can efficiently promote early flowering in an fwa-4 mutant background. SUVR2-Flag-ZF targeting produced 3 out of 30 early flowering plants, but these plants had not flowered as early as the plants targeted by DMS3 or MORC6. Also, SUVR2-HA-ZF produced no early flowering plants. The SUVR2 results suggest that SUVR2 has at least a partial ability, when fused to an FWA-targeting DNA-binding domain, to target and silence FWA. Importantly, of the three proteins in the DDR complex (DRD1, DMS3 and RDM1), only DMS3 was effective at efficiently inducing early flowering relative to fwa-4 in these first generation T1 plants. Also, direct targeting of DRM2 was not effective. Thus, the results suggest that not all RdDM components are effective in efficiently targeting DNA methylation, at least in first generation T1 plants.

As can also be seen in Table 13, MORC6-HA-ZF was effective at inducing early flowering in the fwa-4 mutant. MORC1 (At4g36290) and MORC2 (AT4G36280) are proteins related to MORC6 and Applicants have shown that they form stable heterodimers with MORC6. MORC6 are MORC1 were previously shown by the applicants to be involved in gene silencing (Moissiard et al., 2012). Applicants have also shown that a MORC1 MORC2 double mutant has a very similar phenotype as MORC6 mutants. Thus, it is thought that MORC1 and MORC1b are very likely to also successfully target Pol V, DNA methylation, and gene silencing.

Figure 17:
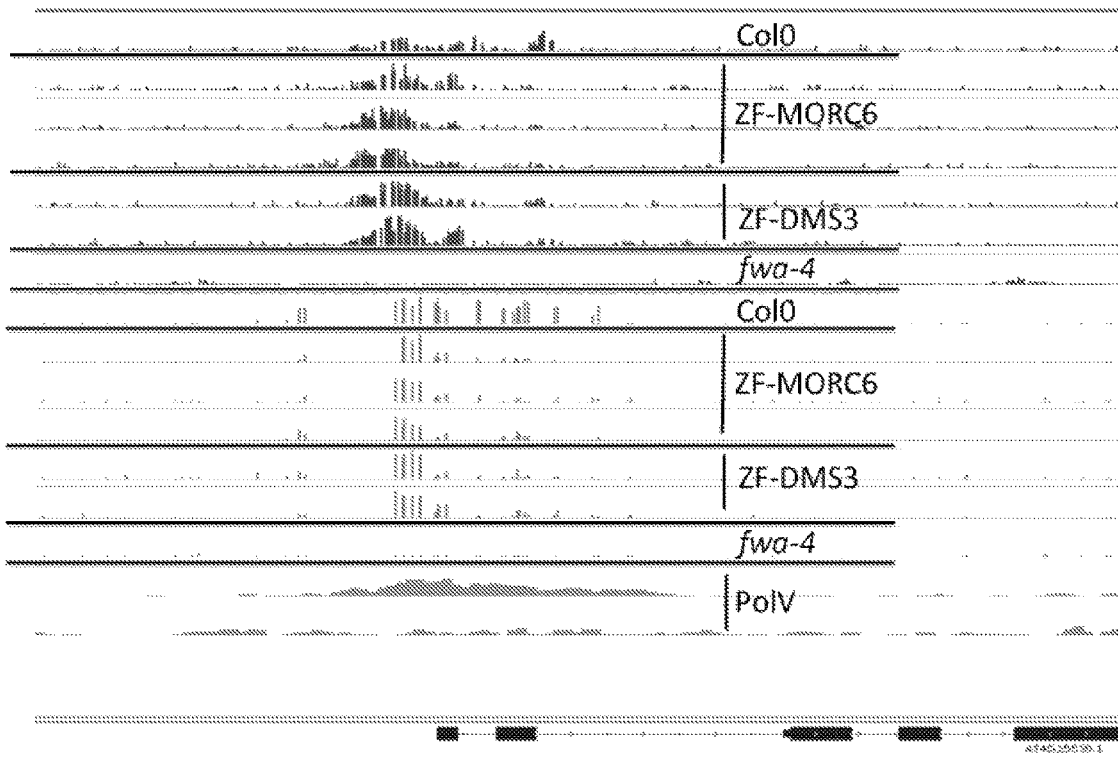
FIG. 17 illustrates CG, CHG, and CHH methylation at the FWA gene in wild-type, fwa-4 and DMS3-ZF and MORC6-ZF early flowering lines. Red color represents CHH methylation, where H is C, A or T. Green color represents CG methylation. Blue color represents CHG methylation. Light blue color represents Pol V binding in wild-type compared to a polV mutant showing PolV binding to the promoter region of FWA in wild-type plants. A schematic representation of the FWA gene is represented in dark blue at the bottom.

In order to analyze whether the early flowering phenotype of the early-flowering lines described in Table 13 was due to the methylation of the FWA promoter, a whole-genome bisulfite sequencing assay was performed in two independent DMS3-ZF lines and 3 independent MORC6-ZF lines that showed the early flowering phenotype relative to fwa-4. Bisulfite sequencing experiments were conducted in a fashion analogous to the method described in Example 4. The results showed that DNA methylation was re-established at FWA in a manner very similar that that previously shown for SUVH2 in Example 4 (FIG. 17). Thus, DMS3 and MORC6 were effective in targeting methylation at the FWA promoter. As described above, the ZF-SUVR2 lines were somewhat effective at inducing early flowering in fwa-4 mutants, and thus are also likely to target DNA methylation to FWA.

In order to further analyze the stability of FWA silencing in these transgenic plants, and to test whether some fusion proteins might show an effect only in later generations, a number of T1 plants for each line were allowed to self-pollinate and flowering time was assayed in the T2 generation, as shown in Table 14. T2 plants derived from early flowering T1 plants from the DMS3-ZF transformants showed 100% early flowering plants in the T2 generation, demonstrating the effectiveness and stability of FWA gene silencing. T2 plants derived from early flowering T1 plants from the MORC6-ZF transformants showed some variability but still most showed 100% early flowering plants in the T2 generation. T2 plants derived from early flowering T1 plants from the SUVR2-ZF transformants showed more variability and only one showed 100% early flowering plants in the T2 generation.

TABLE 14

Early Flowering in T2 lines

| | Line | Early | Late | % Early flowering |
|---|---|---|---|---|
| wild type Col0 | | 28 | 0 | 100% |
| fwa-4 | | 0 | 24 | 0% |
| DRD1-HA ZF | 35 | 1 | 15 | 6% |
| | 34 | 1 | 12 | 8% |
| | 23 | 0 | 10 | 0% |
| | 32 | 0 | 10 | 0% |
| | 31 | 0 | 10 | 0% |
| | 30 | 0 | 9 | 0% |
| | 29 | 0 | 10 | 0% |
| DMS3-Flag-ZF | 7 | 17 | 0 | 100% |
| | 2 | 14 | 0 | 100% |
| | 11 | 8 | 0 | 100% |
| | 12 | 7 | 0 | 100% |
| | 10 | 10 | 0 | 100% |
| | 41 | 8 | 0 | 100% |
| | 9 | 8 | 0 | 100% |
| RDM1-HA-ZF | 15 | 2 | 16 | 11% |
| | 6 | 2 | 13 | 13% |
| | 14 | 0 | 10 | 0% |
| | 16 | 9 | 1 | 90% |
| | 19 | 6 | 4 | 60% |
| | 25 | 1 | 9 | 10% |
| | 24 | 0 | 4 | 0% |
| RDM1-Flag-ZF | 1 | 0 | 18 | 0% |
| | 4 | 0 | 15 | 0% |
| | 10 | 0 | 10 | 0% |
| | 9 | 0 | 10 | 0% |
| | 8 | 0 | 9 | 0% |
| | 2 | 0 | 10 | 0% |
| | 5 | 0 | 10 | 0% |
| HA-2XZF-DRM3 | 32 | 1 | 15 | 6% |
| | 26 | 0 | 15 | 0% |
| | 27 | 18 | 0 | 100% |
| | 15 | 0 | 15 | 0% |
| | 29 | 1 | 7 | 13% |
| | 30 | 0 | 8 | 0% |
| | 24 | 0 | 8 | 0% |
| | 28 | 8 | 2 | 80% |
| | 31 | 0 | 10 | 0% |
| | 25 | 0 | 6 | 0% |
| HA-ZF-DRM3 | 23 | 0 | 18 | 0% |
| | 4 | 0 | 14 | 0% |
| | 26 | 0 | 5 | 0% |
| | 3 | 0 | 5 | 0% |
| | 27 | 0 | 5 | 0% |
| | 25 | 0 | 5 | 0% |
| | 24 | 0 | 5 | 0% |
| | 22 | 0 | 3 | 0% |
| ZF-3F9M-DRM2 | 5 | 17 | 0 | 100% |
| | 6 | 12 | 0 | 100% |
| | 18 | 0 | 8 | 0% |
| | 19 | 0 | 10 | 0% |
| | 20 | 3 | 0 | 100% |
| | 21 | 0 | 10 | 0% |
| | 13 | 0 | 10 | 0% |
| FRG-Flag-ZF | 32 | 7 | 10 | 41% |
| | 4 | 0 | 13 | 0% |

TABLE 14-continued

Early Flowering in T2 lines

| | Line | Early | Late | % Early flowering |
|---|---|---|---|---|
| | 14 | 2 | 7 | 22% |
| | 16 | 0 | 10 | 0% |
| | 19 | 1 | 8 | 11% |
| | 27 | 0 | 10 | 0% |
| | 2 | 2 | 7 | 22% |
| | 1 | 0 | 10 | 0% |
| SUVR2-Flag-ZF | 2 | 15 | 0 | 100% |
| | 22 | 8 | 7 | 53% |
| | 7 | 0 | 10 | 0% |
| | 28 | 0 | 9 | 0% |
| | 1 | 2 | 7 | 22% |
| | 3 | 0 | 8 | 0% |
| | 29 | 1 | 8 | 11% |
| | 30 | 5 | 3 | 63% |
| | 27 | 0 | 10 | 0% |
| | 26 | 1 | 9 | 10% |
| SUVR2-HA-ZF | 18 | 0 | 18 | 0% |
| | 23 | 4 | 10 | 29% |
| | 14 | 0 | 10 | 0% |
| | 12 | 2 | 7 | 22% |
| | 1 | 4 | 5 | 44% |
| | 2 | 1 | 5 | 17% |
| | 3 | 0 | 10 | 0% |
| MORC6-HA-ZF | 3 | 16 | 1 | 94% |
| | 1 | 18 | 0 | 100% |
| | 7 | 7 | 0 | 100% |
| | 8 | 7 | 0 | 100% |
| | 2 | 10 | 0 | 100% |
| | 4 | 4 | 0 | 100% |
| | 3 | 9 | 0 | 100% |
| Flag-ZF-CMT2 | 13 | 0 | 18 | 0% |
| | 7 | 0 | 14 | 0% |
| | 14 | 0 | 10 | 0% |
| | 1 | 0 | 10 | 0% |
| | 22 | 0 | 10 | 0% |
| | 23 | 0 | 10 | 0% |
| | 24 | 0 | 10 | 0% |

Analysis of the T2 generation for other fusion proteins showed that even for some RdDM factors that showed no effect in the T1 generation, a partial effect could be seen in the T2 generation. This was found for the DRD1-ZF, RDM1-ZF, DRM3-ZF, DRM2-ZF, and FRG-ZF (FRG is the gene At3g20010 which Applicants have shown is involved in RdDM) fusion constructs. This demonstrates that the DRD1, RDM1, DRM3, DRM2, and FRG genes may also be useful for targeting Pol V, DNA methylation, and gene silencing, although the efficiency of these genes may be lower and it may require multiple plant generations to observe an effect. As a control, the CMT2 protein was included that is not involved in RdDM, and it was observed that all T2 plants showed 100% late flowering, showing that CMT2 is not effective in targeting silencing of FWA.

Applicants have shown that different RdDM proteins can be targeted to silence specific loci with varying degrees of silencing efficiency. There may be some advantage to having a set of proteins that can provide a range of different efficiencies of gene silencing. For example, depending on the target nucleic acid to be silenced, it may be advantageous to select recombinant proteins of the present disclosure having different silencing efficiencies. For example, it may be an advantage to fully silence the expression of a target gene by selecting a very efficient RdDM component to direct as much methylation as possible to the target gene. In other cases, it might be an advantage to target a less efficient RdDM component to target less methylation to a gene to cause only a partial silencing effect. Genes often show different effects on plant phenotype when they are expressed at different levels, and there are likely to be situations where partial silencing of a plant gene is most advantageous.

Example 6

The following Example relates to the production and characterization of a modified *A. thaliana* SHH1 protein that is engineered to contain a nucleic acid binding domain to target the modified SHH1 protein to a specific nucleic acid sequence, and to the production and characterization of a modified *A. thaliana* SUVH2 protein that is engineered to contain a nucleic acid binding domain to target the modified SUVH2 protein to a specific nucleic acid sequence. In this Example, the targeting of SHH1 and SUVH2 simultaneously to the SUPERMAN promoter region was associated with the enrichment of DNA methylation at SUPERMAN.

Materials and Methods

Construction of TAL-SHH1 and TAL-SUVH2 Chimaera

The Gateway entry clone containing SUVH2 including 1.4 kb of the promoter region and the ORF with N-terminal 3×HA and BLRP tags was described previously (Johnson et al., 2008). The Gateway entry clone containing SHH1 including 1.4 kb of the promoter region and the ORF with C-terminal BLRP and 3×Myc tags was described previously (Law et al., 2011). BsaI recognition sites were removed from the SUVH2 entry clone by site directed mutagenesis (Quickchange multi, Agilent) using primers SUVH2deltaBsaI1, 5'-TCGTTGTCTCGCCGAAATTCGAAAGACCGAGA-GAG-3' (SEQ ID NO: 168), SUVH2deltaBsaI2, 5'-TCAT-CATAGTGTTGTTATATCTTTGGTGTCTCTGTCTT-GCTTC-3' (SEQ ID NO: 175) and SUVH2deltaBsaI3, 5'-CCTTTAATTTCCTTTTTTGTTTGCGTCTC-TACTCTCTACAATCTATA-3' (SEQ ID NO: 169). BsaI recognition sites were removed from the SHH1 entry clone by site directed mutagenesis (Quickchange II, Agilent) using primers SHH1deltaBsaI_fo, 5'-GGGAGAGTGAACGTTG-GTGACCTGCTTCTATGTTT-3' (SEQ ID NO: 170), SHH1deltaBsaI_re, 5'-AAACATAGAAGCAGGTCAC-CAACGTTCACTCTCCC-3' (SEQ ID NO: 171). After removing the BsaI sites the entry clones were linearized by restriction digestions with XhoI. In order to insert the DNA sequence encoding a modified Hax3-based transcription activator-like effector (TALE) (Sanjana et al., 2012) excluding the C-terminal nuclear localization signal and acidic activation domain flanked by GSSGSS linkers in frame in between the C-terminal BLRP and 3×Myc tags of SHH1 or the N-terminal 3×HA and BLRP tags of SUVH2, 2.8 kb of the TALE backbone including the ccdB selection cassette were amplified from TALE transcriptional activator (TALE-TF) plasmids (Addgene) using primers TALETFintotag_fo, 5'-CCAAGGACCTCTCGAGGGATCTTCAGGT-TCATCTTCGCGGACCCGGCTCCCT-3' (SEQ ID NO: 144) and TALETFintoSHH1Myc_re, 5'-CATAGATC-CCTCGAGTGAAGAACCAGATGATCCGCTAGCT-GACGCGCGA-3' (SEQ ID NO: 145) or TALETFintoSUVH2tag_re, 5'-G GTATCCCATCTCGAGT-GAAGAACCAGATGATCCGCTAGCTGACGCGCGA-3' (SEQ ID NO: 172), respectively. Amplicons were fused with the linearized entry clones using In-Fusion HD cloning system (Clontech). Two TALE DNA-binding domains targeting the sequences 5'-GGGGATTTGATAATGCGTC-3' (SEQ ID NO: 173) (SUP_D) corresponding to chromosome 3 from nucleotide positions 8242204 to 8242222 and 5'-GT-TAAGACTGTGAAAGAGA-3' (SEQ ID NO: 174) (SUP_P) corresponding to chromosome 3 from nucleotide positions 8242251 to 8242233 in the promoter region of SUPERMAN (AT3G23130) were assembled from 18 monomer-repeats (Addgene) by Golden Gate cloning and inserted between the BsaI sites flanking the ccdB selection cassette (Sanjana et al., 2012). DNA sequences encoding the TALE target repeats corresponding to SUP_D (SEQ ID NO: 138) and SUP_P (SEQ ID NO: 139) are listed. In order to facilitate binding of the TALE fusion proteins to methylated cytosine the repeat variable "diresidue" (RVD) N* was used (Valton et al., 2012). Plasmids encoding monomer RVDs N* and NH were generated by site-directed mutagenesis (Quickchange II, Agilent) of the TALE monomer template plasmid pNN_v2 (Addgene) using primers NN>N*_fo, 5'-GTGGCAATTGCGAGCAACGGGGGAAAGCAG-3' (SEQ ID NO: 147), NN>N*_re, 5'-CTGCTTTCCCCCGT-TGCTCGCAATTGCCAC-3' (SEQ ID NO: 148), NN>NH_fo, 5'-GGCAATTGCGAGCAAC-CATGGGGGAAAGCAGGCAC-3' (SEQ ID NO: 149) and NN>NH_re, 5'-GTGCCTGCTTTCCCCCATGGTT-GCTCGCAATTGCC-3' (SEQ ID NO: 150), respectively. TALE-TF plasmid encoding RVD N* was generated by site-directed mutagenesis (Quickchange II, Agilent) of pTALE-TF_v2 (NN) (Addgene) using primers TALETF_NN>N*_fo, 5'-TGGCTATTGCATC-CAACGGGGGCAGACC-3' (SEQ ID NO: 151) and TALETF_NN>N*_re, 5'-GGTCTGCCCCCGTTGGATG-CAATAGCCA-3' (SEQ ID NO: 152). Binary vectors were generated using LR clonase II (Life Technologies) and modified pEarlyGate302 destination vectors containing Bar or hph selection markers (Law et al., 2011).

Plant Material

TAL-SHH1 constructs were transformed into shh1 (SALK_074540), and TAL-SUVH2 into suvh2 (SALK_079574) of ecotype Col-0 by *Agrobacterium tumefaciens* strain ABL0 using the floral dip method (Clough and Bent, 1998). T1 plants were selected with Glufosinate or Hygromycin B and expression of the chimeric TAL-SHH1 or TAL-SUVH2 proteins was tested by protein isolation and Western blot with antibodies against the 3×Myc or 3×HA tag, respectively. T1 plants showing strong transgene expression were crossed in order to combine TAL-SUVH2 with TAL-SHH1 or hairpin constructs for the target region of the SUPERMAN (At3g23130) gene. F1 plants were genotyped by PCR to determine the presence of the transgenes.

Results

Figure 19:
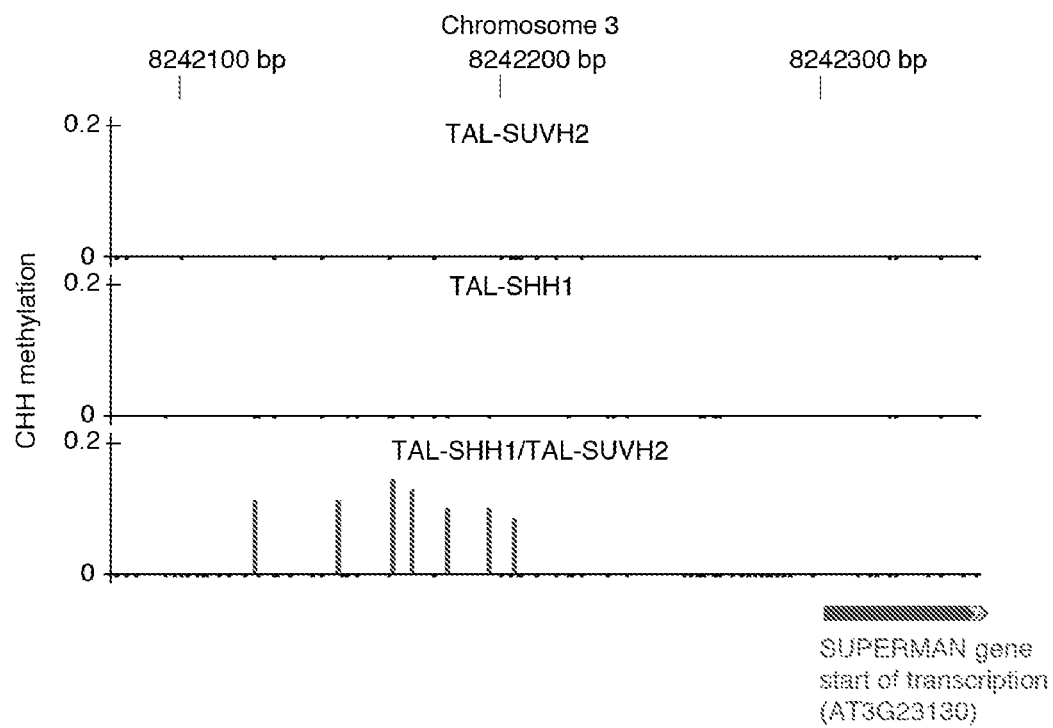
FIG. 19 illustrates CHH DNA methylation at the SUPERMAN gene (At3g23130) promoter region in F1 plants containing only TAL-SUVH2, TAL-SHH1, or both TAL-SHH1 and TAL-SUVH2 (TAL-SHH1/TAL-SUVH2).

After selecting F1 plants containing either the TAL-SHH1 directed against the SUPERMAN gene, a TAL-SUVH2 directed against the SUPERMAN gene, or a plant containing both the TAL-SHH1 and TAL-SUVH2 transgenes, whole genome bisulfite libraries were prepared using established protocols (Law et al., 2013). These libraries were deeply sequenced and reads were mapped to the *Arabidopsis* genome as previously described (Law et al., 2013). As shown in FIG. 19, CHH DNA methylation was detected at the SUPERMAN gene in plants containing both the TAL-SHH1 and TAL-SUVH2 transgenes, but not in plants containing either the TAL-SHH1 or TAL-SUVH2 transgenes alone. These results suggest that targeting SHH1 and SUVH2 to the SUPERMAN promoter region was sufficient to cause CHH DNA methylation.

REFERENCES

Law, J. A. & Jacobsen, S. E. Establishing, maintaining and modifying DNA methylation patterns in plants and animals. Nat Rev Genet 11, 204-220 (2010).

Haag, J. R. & Pikaard, C. S. Multisubunit RNA polymerases IV and V: purveyors of non-coding RNA for plant gene silencing. Nat Rev Mol Cell Biol 12, 483-492, doi:10.1038/nrm3152 (2011).

Law, J. A., Vashisht, A. A., Wohlschlegel, J. A. & Jacobsen, S. E. SHH1, a Homeodomain Protein Required for DNA Methylation, As Well As RDR2, RDM4, and Chromatin Remodeling Factors, Associate with RNA Polymerase IV. PLoS Genet 7, e1002195, doi:10.1371/journal.pgen.1002195 (2011).

Liu, J. et al. An atypical component of RNA-directed DNA methylation machinery has both DNA methylation-dependent and -independent roles in locus-specific transcriptional gene silencing. Cell Res 21, 1691-1700, doi:10.1038/cr.2011.173 (2011).

Olovnikov, I., Aravin, A. A. & Fejes Toth, K. Small RNA in the nucleus: the RNA-chromatin ping-pong. Curr Opin Genet Dev 22, 164-171, doi:10.1016/j.gde.2012.01.002 (2012).

Mosher, R. A., Schwach, F., Studholme, D. & Baulcombe, D. C. PolIVb influences RNA-directed DNA methylation independently of its role in siRNA biogenesis. Proc Natl Acad Sci USA 105, 3145-3150 (2008).

Zhang, X., Henderson, I. R., Lu, C., Green, P. J. & Jacobsen, S. E. Role of RNA polymerase IV in plant small RNA metabolism. Proc Natl Acad Sci USA 104, 4536-4541 (2007).

Cokus, S. J. et al. Shotgun bisulphite sequencing of the Arabidopsis genome reveals DNA methylation patterning. Nature 452, 215-219 (2008).

Cao, X. et al. Role of the DRM and CMT3 methyltransferases in RNA-directed DNA methylation. Curr Biol 13, 2212-2217 (2003).

Du, J. et al. Dual Binding of Chromomethylase Domains to H3K9me2-containing Nucleosomes Directs DNA Methylation in Plants. Cell Accepted (2012).

Thong, X. et al. DDR complex facilitates global association of RNA polymerase V to promoters and evolutionarily young transposons. Nat Struct Mol Biol, doi:10.1038/nsmb.2354 (2012).

Mukherjee, K., Brocchieri, L. & Burglin, T. R. A comprehensive classification and evolutionary analysis of plant homeobox genes. Mol Biol Evol 26, 2775-2794 (2009).

Cedar, H. & Bergman, Y. Linking DNA methylation and histone modification: patterns and paradigms. Nat Rev Genet 10, 295-304 (2009).

Zhang, X., Bernatavichute, Y. V., Cokus, S., Pellegrini, M. & Jacobsen, S. E. Genome-wide analysis of mono-, di- and trimethylation of histone H3 lysine 4 in Arabidopsis thaliana. Genome Biol 10, R62 (2009).

Bian, C. et al. Sgf29 binds histone H3K4me2/3 and is required for SAGA complex recruitment and histone H3 acetylation. EMBO J 30, 2829-2842, doi:10.1038/emboj.2011.193 (2011).

Holm, L. & Rosenstrom, P. Dali server: conservation mapping in 3D. Nucleic Acids Res 38, W545-549, doi:10.1093/nar/gkq366 (2010).

Nady, N. et al. Recognition of multivalent histone states associated with heterochromatin by UHRF1 protein. Journal of Biological Chemistry 286, 24300-24311, doi:10.1074/jbc.M111.234104 (2011).

Bernatavichute, Y. V., Zhang, X., Cokus, S., Pellegrini, M. & Jacobsen, S. E. Genome-wide association of histone H3 lysine nine methylation with CHG DNA methylation in Arabidopsis thaliana. PLoS ONE 3, e3156 (2008).

Taverna, S. D., Li, H., Ruthenburg, A. J., Allis, C. D. & Patel, D. J. How chromatin-binding modules interpret histone modifications: lessons from professional pocket pickers. Nat Struct Mol Biol 14, 1025-1040, doi:10.1038/nsmb1338 (2007).

Zhang, X. et al. Genome-wide high-resolution mapping and functional analysis of DNA methylation in arabidopsis. Cell 126, 1189-1201 (2006).

Zilberman, D. et al. Role of Arabidopsis ARGONAUTE4 in RNA-directed DNA methylation triggered by inverted repeats. Curr Biol 14, 1214-1220 (2004).

Xie, Z. et al. Genetic and functional diversification of small RNA pathways in plants. PLoS Biol 2, E104 (2004).

Li, C. F. et al. An ARGONAUTE4-containing nuclear processing center colocalized with Cajal bodies in Arabidopsis thaliana. Cell 126, 93-106 (2006).

Pontes, O. et al. The Arabidopsis chromatin-modifying nuclear siRNA pathway involves a nucleolar RNA processing center. Cell 126, 79-92 (2006).

Zilberman, D., Cao, X. & Jacobsen, S. E. ARGONAUTE4 control of locus-specific siRNA accumulation and DNA and histone methylation. Science 299, 716-719 (2003).

Adams, P. D., Afonine, P. V., Bunkoczi, G., Chen, V. B., Davis, I. W., Echols, N., Headd, J. J., Hung, L. W., Kapral, G. J., Grosse-Kunstleve, R. W., et al. (2010). PHENIX: a comprehensive Python-based system for macromolecular structure solution. Acta crystallographica Section D, Biological crystallography 66, 213-221.

Arita, K., Ariyoshi, M., Tochio, H., Nakamura, Y., and Shirakawa, M. (2008). Recognition of hemi-methylated DNA by the SRA protein UHRF1 by a base-flipping mechanism. Nature 455, 818-821.

Aufsatz, W., Mette, M. F., van der Winden, J., Matzke, A. J., and Matzke, M. (2002). RNA-directed DNA methylation in Arabidopsis. Proceedings of the National Academy of Sciences of the United States of America 99 Suppl 4, 16499-16506.

Aufsatz, W., Mette, M. F., Matzke, A. J. & Matzke, M. The role of MET1 in RNA-directed de novo and maintenance methylation of CG dinucleotides. Plant Molecular Biology 54, 793-804 (2004).

Avvakumov, G. V., Walker, J. R., Xue, S., Li, Y., Duan, S., Bronner, C., Arrowsmith, C. H., and Dhe-Paganon, S. (2008). Structural basis for recognition of hemi-methylated DNA by the SRA domain of human UHRF1. Nature 455, 822-825.

Bernatavichute, Y. V., Zhang, X., Cokus, S., Pellegrini, M., and Jacobsen, S. E. (2008). Genome-wide association of histone H3 lysine nine methylation with CHG DNA methylation in Arabidopsis thaliana. PloS one 3, e3156.

Black, J. C., Van Rechem, C., and Whetstine, J. R. (2012). Histone lysine methylation dynamics: establishment, regulation, and biological impact. Molecular cell 48, 491-507.

Bostick, M., Kim, J. K., Esteve, P. O., Clark, A., Pradhan, S., and Jacobsen, S. E. (2007). UHRF1 plays a role in maintaining DNA methylation in mammalian cells. Science 317, 1760-1764.

Brzeski, J., and Jerzmanowski, A. (2003). Deficient in DNA methylation 1 (DDM1) defines a novel family of chromatin-remodeling factors. The Journal of biological chemistry 278, 823-828.

Cao, X., and Jacobsen, S. E. (2002). Role of the arabidopsis DRM methyltransferases in de novo DNA methylation and gene silencing. Current biology: CB 12, 1138-1144.

Chan, S. W., Zhang, X., Bernatavichute, Y. V., and Jacobsen, S. E. (2006). Two-step recruitment of RNA-directed DNA methylation to tandem repeats. PLoS biology 4, e363.

Du, J., Zhong, X., Bernatavichute, Y. V., Stroud, H., Feng, S., Caro, E., Vashisht, A. A., Terragni, J., Chin, H. G., Tu, A., et al. (2012). Dual Binding of Chromomethylase Domains to H3K9me2-Containing Nucleosomes Directs DNA Methylation in Plants. Cell 151, 167-180.

Ebbs, M. L., and Bender, J. (2006). Locus-specific control of DNA methylation by the Arabidopsis SUVH5 histone methyltransferase. The Plant cell 18, 1166-1176.

El-Shami, M., Pontier, D., Lahmy, S., Braun, L., Picart, C., Vega, D., Hakimi, M. A., Jacobsen, S. E., Cooke, R., and Lagrange, T. (2007). Reiterated WG/GW motifs form functionally and evolutionarily conserved ARGO-NAUTE-binding platforms in RNAi-related components. Genes & development 21, 2539-2544.

Emsley, P., Lohkamp, B., Scott, W. G., and Cowtan, K. (2010). Features and development of Coot. Acta crystallographica Section D, Biological crystallography 66, 486-501.

Feng, S., Rubbi, L., Jacobsen, S. E., and Pellegrini, P. (2011). Determining DNA Methylation Profiles Using Sequencing. Methods in Molecular Biology 733, 223-238.

Finnegan, E. J., and Dennis, E. S. (1993). Isolation and identification by sequence homology of a putative cytosine methyltransferase from Arabidopsis thaliana. Nucleic acids research 21, 2383-2388.

Gouet, P., Courcelle, E., Stuart, D. I., and Metoz, F. (1999). ESPript: analysis of multiple sequence alignments in PostScript. Bioinformatics 15, 305-308.

Greenberg, M. V., Ausin, I., Chan, S. W., Cokus, S. J., Cuperus, J. T., Feng, S., Law, J. A., Chu, C., Pellegrini, M., Carrington, J. C., et al. (2011). Identification of genes required for de novo DNA methylation in Arabidopsis. Epigenetics: official journal of the DNA Methylation Society 6, 344-354.

Hashimoto, H., Horton, J. R., Zhang, X., Bostick, M., Jacobsen, S. E., and Cheng, X. (2008). The SRA domain of UHRF1 flips 5-methylcytosine out of the DNA helix. Nature 455, 826-829.

Jackson, J. P., Lindroth, A. M., Cao, X., and Jacobsen, S. E. (2002). Control of CpNpG DNA methylation by the KRYPTONITE histone H3 methyltransferase. Nature 416, 556-560.

Johnson, L. M., Bostick, M., Zhang, X., Kraft, E., Henderson, I., Callis, J., and Jacobsen, S. E. (2007). The SRA methyl-cytosine-binding domain links DNA and histone methylation. Current biology: CB 17, 379-384.

Johnson, L. M., Law, J. A., Khattar, A., Henderson, I. R., and Jacobsen, S. E. (2008). SRA-domain proteins required for DRM2-mediated de novo DNA methylation. PLoS genetics 4, e1000280.

Jones, P. A. (2012). Functions of DNA methylation: islands, start sites, gene bodies and beyond. Nature reviews Genetics 13, 484-492.

Kakutani, T. (1997). Genetic characterization of late-flowering traits induced by DNA hypomethylation mutation in Arabidopsis thaliana. The Plant journal: for cell and molecular biology 12, 1447-1451.

Kinoshita, Y., Saze, H., Kinoshita, T., Miura, A., Soppe, W. J., Koornneef, M., and Kakutani, T. (2007). Control of FWA gene silencing in Arabidopsis thaliana by SINE-related direct repeats. The Plant journal: for cell and molecular biology 49, 38-45.

Kolb, A. F., Coates, C. J., Kaminski, J. M., Summers, J. B., Miller, A. D., and Segal, D. J. (2005). Site-directed genome modification: nucleic acid and protein modules for targeted integration and gene correction. Trends in biotechnology 23, 399-406.

Kuhlmann, M., and Mette, M. F. (2012). Developmentally non-redundant SET domain proteins SUVH2 and SUVH9 are required for transcriptional gene silencing in Arabidopsis thaliana. Plant molecular biology.

Larkin, M. A., Blackshields, G., Brown, N. P., Chenna, R., McGettigan, P. A., McWilliam, H., Valentin, F., Wallace, I. M., Wilm, A., Lopez, R., et al. (2007). Clustal W and Clustal X version 2.0. Bioinformatics 23, 2947-2948.

Laskowski, R. A., Macarthur, M. W., Moss, D. S., and Thornton, J. M. (1993). PROCHECK: a program to check the stereochemical quality of protein structures. J Appl Crystallogr 26, 283-291.

Law, J. A., Ausin, I., Johnson, L. M., Vashisht, A. A., Zhu, J. K., Wohlschlegel, J. A., and Jacobsen, S. E. (2010). A protein complex required for polymerase V transcripts and RNA-directed DNA methylation in Arabidopsis. Current biology: CB 20, 951-956.

Law, J. A., and Jacobsen, S. E. (2010). Establishing, maintaining and modifying DNA methylation patterns in plants and animals. Nature reviews Genetics 11, 204-220.

Lindroth, A. M., Cao, X., Jackson, J. P., Zilberman, D., McCallum, C. M., Henikoff, S., and Jacobsen, S. E. (2001). Requirement of CHROMOMETHYLASE3 for maintenance of CpXpG methylation. Science 292, 2077-2080.

Lindroth, A. M., Shultis, D., Jasencakova, Z., Fuchs, J., Johnson, L., Schubert, D., Patnaik, D., Pradhan, S., Goodrich, J., Schubert, I., et al. (2004). Dual histone H3 methylation marks at lysines 9 and 27 required for interaction with CHROMOMETHYLASE3. The EMBO journal 23, 4286-4296.

Lister, R. et al. Highly integrated single-base resolution maps of the epigenome in Arabidopsis. Cell 133, 523-536 (2008).

Malagnac, F., Bartee, L., and Bender, J. (2002). An Arabidopsis SET domain protein required for maintenance but not establishment of DNA methylation. The EMBO journal 21, 6842-6852.

Otwinowski, Z., and Minor, W. (1997). Processing of X-ray diffraction data collected in oscillation mode. Methods Enzymol 276, 307-326.

Pelissier, T., and Wassenegger, M. (2000). A DNA target of 30 bp is sufficient for RNA-directed DNA methylation. RNA 6, 55-65.

Pikaard, C. S., Haag, J. R., Ream, T., and Wierzbicki, A. T. (2008). Roles of RNA polymerase IV in gene silencing. Trends in plant science 13, 390-397.

Pontier, D., Yahubyan, G., Vega, D., Bulski, A., Saez-Vasquez, J., Hakimi, M. A., Lerbs-Mache, S., Colot, V., and Lagrange, T. (2005). Reinforcement of silencing at transposons and highly repeated sequences requires the concerted action of two distinct RNA polymerases IV in Arabidopsis. Genes & development 19, 2030-2040.

Rajakumara, E., Law, J. A., Simanshu, D. K., Voigt, P., Johnson, L. M., Reinberg, D., Patel, D. J., and Jacobsen, S. E. (2011). A dual flip-out mechanism for 5mC recognition by the Arabidopsis SUVH5 SRA domain and its impact on DNA methylation and H3K9 dimethylation in vivo. Genes & development 25, 137-152.

Rincon-Arano, H., Halow, J., Delrow, J. J., Parkhurst, S. M., and Groudine, M. (2012). UpSET Recruits HDAC Complexes and Restricts Chromatin Accessibility and Acetylation at Promoter Regions. Cell 151, 1214-1228.

Segal, D. J., Beerli, R. R., Blancafort, P., Dreier, B., Effertz, K., Huber, A., Koksch, B., Lund, C. V., Magnenat, L., Valente, D., et al. (2003). Evaluation of a modular strategy for the construction of novel polydactyl zinc finger DNA-binding proteins. Biochemistry 42, 2137-2148.

Smith, E., and Shilatifard, A. (2010). The chromatin signaling pathway: diverse mechanisms of recruitment of histone-modifying enzymes and varied biological outcomes. Molecular cell 40, 689-701.

Soppe, W. J., Jacobsen, S. E., Alonso-Blanco, C., Jackson, J. P., Kakutani, T., Koornneef, M., and Peeters, A. J. (2000). The late flowering phenotype of fwa mutants is caused by gain-of-function epigenetic alleles of a homeodomain gene. Molecular cell 6, 791-802.

Springer, N. M., Napoli, C. A., Selinger, D. A., Pandey, R., Cone, K. C., Chandler, V. L., Kaeppler, H. F., and Kaeppler, S. M. (2003). Comparative analysis of SET domain proteins in maize and *Arabidopsis* reveals multiple duplications preceding the divergence of monocots and dicots. Plant physiology 132, 907-925.

Stroud, H., Greenberg, M. V., Feng, S., Bernatavichute, Y. V., and Jacobsen, S. E. (2013). Comprehensive analysis of silencing mutants reveals complex regulation of the *Arabidopsis* methylome. Cell 152, 352-364.

Wierzbicki, A. T., Haag, J. R., and Pikaard, C. S. (2008). Noncoding transcription by RNA polymerase Pol IVb/Pol V mediates transcriptional silencing of overlapping and adjacent genes. Cell 135, 635-648.

Wierzbicki, A. T., Ream, T. S., Haag, J. R., and Pikaard, C. S. (2009). RNA polymerase V transcription guides ARGONAUTE4 to chromatin. Nature genetics 41, 630-634.

Woo, H. R., Dittmer, T. A., and Richards, E. J. (2008). Three SRA-domain methylcytosine-binding proteins cooperate to maintain global CpG methylation and epigenetic silencing in *Arabidopsis*. PLoS genetics 4, e1000156.

Wu, H., Min, J., Lunin, V. V., Antoshenko, T., Dombrovski, L., Zeng, H., Allali-Hassani, A., Campagna-Slater, V., Vedadi, M., Arrowsmith, C. H., et al. (2010). Structural biology of human H3K9 methyltransferases. PloS one 5, e8570.

Zhang, X., Tamaru, H., Khan, S. I., Horton, J. R., Keefe, L. J., Selker, E. U., and Cheng, X. (2002). Structure of the *Neurospora* SET domain protein DIM-5, a histone H3 lysine methyltransferase. Cell 11, 117-127.

Zhang, X., Yang, Z., Khan, S. I., Horton, J. R., Tamaru, H., Selker, E. U., and Cheng, X. (2003). Structural basis for the product specificity of histone lysine methyltransferases. Molecular cell 12, 177-185.

Thong, X., Hale, C. J., Law, J. A., Johnson, L. M., Feng, S., Tu, A., and Jacobsen, S. E. (2012). DDR complex facilitates global association of RNA polymerase V to promoters and evolutionarily young transposons. Nature structural & molecular biology.

Clough, S. J., and Bent, A. F. (1998). Floral dip: a simplified method for *Agrobacterium*-mediated transformation of *Arabidopsis thaliana*. The Plant journal: for cell and molecular biology 16, 735-743.

Law, J. A., Du, J., Hale, C. J., Feng, S., Krajewski, K., Palanca, A. M., Strahl, B. D., Patel, D. J., and Jacobsen, S. E. (2013). Polymerase IV occupancy at RNA-directed DNA methylation sites requires SHH1. Nature 498, 385-389.

Sanjana, N. E., Cong, L., Zhou, Y., Cunniff, M. M., Feng, G., and Zhang, F. (2012). A transcription activator-like effector toolbox for genome engineering. Nature protocols 7, 171-192.

Valton, J., Dupuy, A., Daboussi, F., Thomas, S., Marechal, A., Macmaster, R., Melliand, K., Juillerat, A., and Duchateau, P. (2012). Overcoming transcription activator-like effector (TALE) DNA binding domain sensitivity to cytosine methylation. The Journal of biological chemistry 287, 38427-38432.

Guillaume Moissiard, Shawn J. Cokus, Joshua Cary, Suhua Feng, Allison C. Billi, Hume Stroud, Dylan Husmann, Ye Zhan, Bryan R. Lajoie, Rachel Patton McCord, Christopher J. Hale, Wei Feng, Scott D. Michaels, Alison R. Frand, Matteo Pellegrini, Job Dekker, John K. Kim, and Steven E. Jacobsen. (2012) MORC Family ATPases Required for Heterochromatin Condensation and Gene Silencing. Science, 336:1448-1451.

Ian R. Henderson, Angelique Deleris, William Wong, Xuehua Zhong, Hang Gyeong Chin, Gregory A. Horwitz, Krystyna A. Kelly, Sriharsa Pradhan, Steven E. Jacobsen. (2010) The De Novo Cytosine Methyltransferase DRM2 Requires Intact UBA Domains and a Catalytically Mutated Paralog DRM3 during RNA—Directed DNA Methylation in *Arabidopsis thaliana*. PLoS Genetics, (6) 10: e1001182.

STATEMENTS OF EMBODIMENTS

1. A method for reducing expression of one or more target nucleic acids in a plant, comprising:
   (a) providing a plant comprising a recombinant nucleic acid, wherein the recombinant nucleic acid encodes a recombinant polypeptide comprising a first amino acid sequence comprising a DNA-binding domain and a second amino acid sequence comprising an SHH1 polypeptide or a fragment thereof; and
   (b) growing the plant under conditions whereby the recombinant polypeptide encoded by the recombinant nucleic acid is expressed and binds to the one or more target nucleic acids, thereby reducing expression of the one or more target nucleic acids.

2. The method of embodiment 1, wherein the DNA-binding domain comprises a zinc finger domain.

3. The method of embodiment 2, wherein the zinc finger domain comprises two, three, four, five, six, seven, eight, or nine zinc fingers.

4. The method of embodiment 2, wherein the zinc finger domain is a zinc finger array.

5. The method of embodiment 2, wherein the zinc finger domain is selected from the group consisting of a Cys2His2 (C2H2) zinc finger domain, a CCCH zinc finger domain, a multi-cysteine zinc finger domain, and a zinc binuclear cluster domain.

6. The method of embodiment 1, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

7. The method of embodiment 1, wherein the DNA-binding domain comprises a TAL effector targeting domain.

8. The method of embodiment 1, wherein the DNA-binding domain comprises three C2H2 zinc finger domains.

9. The method of any one of embodiments 1-8, wherein the second amino acid sequence comprises at least one of a homeodomain or a SAWADEE domain.

10. The method of embodiment 1, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 1.

11. The method of embodiment 1, wherein the second amino acid sequence comprises an amino acid sequence that is 100% identical to SEQ ID NO: 1.

12. The method of any one of embodiments 1-11, wherein the recombinant polypeptide interacts with an RNA polymerase.

13. The method of embodiment 12, wherein the RNA polymerase is RNA polymerase IV.

14. The method of any one of embodiments 1-13, wherein the recombinant polypeptide induces RNA-directed DNA methylation.

15. The method of any one of embodiments 1-14, wherein the one or more target nucleic acids are endogenous nucleic acids.

16. The method of any one of embodiments 1-14, wherein the one or more target nucleic acids are heterologous nucleic acids.

17. The method of any one of embodiments 1-16, wherein expression of the one or more target nucleic acids is silenced.

18. A recombinant nucleic acid encoding an SHH1-like protein comprising a first amino acid sequence comprising a DNA-binding domain and a second amino acid sequence comprising an SHH1 polypeptide or a fragment thereof.

19. The recombinant nucleic acid of embodiment 18, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 1.

20. The recombinant nucleic acid of embodiment 18, wherein the second amino acid sequence comprises an amino acid sequence that is 100% identical to SEQ ID NO: 1.

21. The recombinant nucleic acid of any one of embodiments 18-20, wherein the DNA-binding domain comprises a zinc finger domain.

22. The recombinant nucleic acid of embodiment 21, wherein the zinc finger domain comprises two, three, four, five, six, seven, eight, or nine zinc fingers.

23. The recombinant nucleic acid of embodiment 21, wherein the zinc finger domain is a zinc finger array.

24. The recombinant nucleic acid of embodiment 21, wherein the zinc finger domain is selected from the group consisting of a C2H2 zinc finger domain, a CCCH zinc finger domain, a multi-cysteine zinc finger domain, and a zinc binuclear cluster domain.

25. The recombinant nucleic acid of any one of embodiments 18-20, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

26. The recombinant nucleic acid of any one of embodiments 18-20, wherein the DNA-binding domain comprises a TAL effector targeting domain.

27. The recombinant nucleic acid of any one of embodiments 18-20, wherein the DNA-binding domain binds one or more target nucleic acids.

28. The recombinant nucleic acid of embodiment 27, wherein the one or more target nucleic acids are polypeptide-encoding nucleic acids.

29. The recombinant nucleic acid of embodiment 27, wherein the one or more target nucleic acids are endogenous plant nucleic acids.

30. The recombinant nucleic acid of embodiment 27, wherein the one or more target nucleic acids are heterologous nucleic acids.

31. The recombinant nucleic acid of any one of embodiments 27-30, wherein the SHH1-like protein reduces expression of the one or more target nucleic acids.

32. The recombinant nucleic acid of any one of embodiments 27-30, wherein the SHH1-like protein silences expression of the one or more target nucleic acids.

33. A vector comprising the recombinant nucleic acid of any one of embodiments 18-32, wherein the recombinant nucleic acid is operably linked to a regulatory sequence.

34. A host cell comprising the expression vector of embodiment 33.

35. The host cell of embodiment 34, wherein the host cell is a plant cell.

36. A recombinant plant comprising the recombinant nucleic acid of any one of embodiments 18-32.

37. A method for reducing expression of one or more target nucleic acids in a plant, comprising:
 (a) providing a plant comprising a recombinant nucleic acid, wherein the recombinant nucleic acid encodes a recombinant polypeptide comprising a first amino acid sequence comprising a DNA-binding domain and a second amino acid sequence comprising a SUVH2 polypeptide or a fragment thereof, or a SUVH9 polypeptide or a fragment thereof; and
 (b) growing the plant under conditions whereby the recombinant polypeptide encoded by the recombinant nucleic acid is expressed and binds to the one or more target nucleic acids, thereby reducing expression of the one or more target nucleic acids.

38. The method of embodiment 37, wherein the DNA-binding domain comprises a zinc finger domain.

39. The method of embodiment 38, wherein the zinc finger domain comprises two, three, four, five, six, seven, eight, or nine zinc fingers.

40. The method of embodiment 38, wherein the zinc finger domain is a zinc finger array.

41. The method of embodiment 38, wherein the zinc finger domain is selected from the group consisting of a Cys2His2 (C2H2) zinc finger domain, a CCCH zinc finger domain, a multi-cysteine zinc finger domain, and a zinc binuclear cluster domain.

42. The method of embodiment 37, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

43. The method of embodiment 37, wherein the DNA-binding domain comprises a TAL effector targeting domain.

44. The method of embodiment 37, wherein the DNA-binding domain comprises three C2H2 zinc finger domains.

45. The method of any one of embodiments 37-45, wherein the second amino acid sequence comprises a domain selected from the group consisting of a two-helix bundle domain, a SRA domain, a pre-SET domain, and a SET domain.
46. The method of embodiment 37, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 14 or SEQ ID NO: 27.
47. The method of embodiment 37, wherein the second amino acid sequence comprises an amino acid sequence that is 100% identical to SEQ ID NO: 14 or SEQ ID NO: 27.
48. The method of any one of embodiments 37-47, wherein the recombinant polypeptide interacts with an RNA polymerase.
49. The method of embodiment 48, wherein the RNA polymerase is RNA polymerase V.
50. The method of any one of embodiments 37-49, wherein the recombinant polypeptide induces RNA-directed DNA methylation.
51. The method of any one of embodiment 37-50, wherein the one or more target nucleic acids are endogenous nucleic acids.
52. The method of any one of embodiments 37-50, wherein the one or more target nucleic acids are heterologous nucleic acids.
53. The method of any one of embodiments 37-52, wherein expression of the one or more target nucleic acids is silenced.
54. A recombinant nucleic acid encoding a SUVH2-like protein or a SUVH9-like protein comprising a first amino acid sequence comprising a DNA-binding domain and a second amino acid sequence comprising a SUVH2 polypeptide or a fragment thereof, or a SUVH9 polypeptide or a fragment thereof.
55. The recombinant nucleic acid of embodiment 54, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 14 or SEQ ID NO: 27.
56. The recombinant nucleic acid of embodiment 54, wherein the second amino acid sequence comprises an amino acid sequence that is 100% identical to SEQ ID NO: 14 or SEQ ID NO: 27.
57. The recombinant nucleic acid of any one of embodiments 54-56, wherein the DNA-binding domain comprises a zinc finger domain.
58. The recombinant nucleic acid of embodiment 57, wherein the zinc finger domain comprises two, three, four, five, six, seven, eight, or nine zinc fingers.
59. The recombinant nucleic acid of embodiment 57, wherein the zinc finger domain is a zinc finger array.
60. The recombinant nucleic acid of embodiment 57, wherein the zinc finger domain is selected from the group consisting of a C2H2 zinc finger domain, a CCCH zinc finger domain, a multi-cysteine zinc finger domain, and a zinc binuclear cluster domain.
61. The recombinant nucleic acid of any one of embodiments 54-56, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.
62. The recombinant nucleic acid of any one of embodiments 54-56, wherein the DNA-binding domain comprises a TAL effector targeting domain.
63. The recombinant nucleic acid of any one of embodiments 54-62, wherein the DNA-binding domain binds one or more target nucleic acids.
64. The recombinant nucleic acid of embodiment 63, wherein the one or more target nucleic acids are polypeptide-encoding nucleic acids.
65. The recombinant nucleic acid of embodiment 63, wherein the one or more target nucleic acids are endogenous plant nucleic acids.
66. The recombinant nucleic acid of embodiment 63, wherein the one or more target nucleic acids are heterologous nucleic acids.
67. The recombinant nucleic acid of any one of embodiments 63-66, wherein the SUVH2-like protein or SUVH9-like protein reduces expression of the one or more target nucleic acids.
68. A vector comprising the recombinant nucleic acid of any one of embodiments 54-67, wherein the recombinant nucleic acid is operably linked to a regulatory sequence.
69. A host cell comprising the expression vector of embodiment 68.
70. The host cell of embodiment 69, wherein the host cell is a plant cell.
71. A recombinant plant comprising the recombinant nucleic acid of any one of embodiments 54-67.
72. A method for reducing expression of one or more target nucleic acids in a plant, comprising:
    (a) providing a plant comprising:
        a first recombinant nucleic acid encoding a first recombinant polypeptide comprising a first amino acid sequence comprising a DNA-binding domain and a second amino acid sequence comprising an SHH1 polypeptide or a fragment thereof, and
        a second recombinant nucleic acid encoding a second recombinant polypeptide comprising a first amino acid sequence comprising a DNA-binding domain and a second amino acid sequence comprising a SUVH2 polypeptide or a fragment thereof, or a SUVH9 polypeptide or a fragment thereof; and
    (b) growing the plant under conditions whereby the first recombinant polypeptide encoded by the first recombinant nucleic acid and the second recombinant polypeptide encoded by the second recombinant nucleic acid are expressed and bind to the one or more target nucleic acids, thereby reducing expression of the one or more target nucleic acids.
73. The method of embodiment 72, wherein at least one of the first or second recombinant polypeptides induces RNA-directed DNA methylation.
74. The method of any one of embodiments 72-73, wherein the one or more target nucleic acids are endogenous nucleic acids.
75. The method of any one of embodiments 72-73, wherein the one or more target nucleic acids are heterologous nucleic acids.

76. The method of any one of embodiment 72-75, wherein expression of the one or more target nucleic acids is silenced.

77. A host cell comprising the expression vectors of embodiments 33 and 68.

78. The host cell of embodiment 77, wherein the host cell is a plant cell.

79. A recombinant plant comprising the recombinant nucleic acid of any one of embodiments 18-32 and any one of embodiments 54-67.

80. A method for reducing expression of one or more target nucleic acids in a plant, comprising:
(a) providing a plant comprising a recombinant nucleic acid, wherein the recombinant nucleic acid encodes a recombinant polypeptide comprising a first amino acid sequence comprising a DNA-binding domain and a second amino acid sequence comprising a DMS3 polypeptide or a fragment thereof; and
(b) growing the plant under conditions whereby the recombinant polypeptide encoded by the recombinant nucleic acid is expressed and binds to the one or more target nucleic acids, thereby reducing expression of the one or more target nucleic acids.

81. The method of embodiment 80, wherein the DNA-binding domain comprises a zinc finger domain.

82. The method of embodiment 81, wherein the zinc finger domain comprises two, three, four, five, six, seven, eight, or nine zinc fingers.

83. The method of embodiment 81, wherein the zinc finger domain is a zinc finger array.

84. The method of embodiment 81, wherein the zinc finger domain is selected from the group consisting of a Cys2His2 (C2H2) zinc finger domain, a CCCH zinc finger domain, a multi-cysteine zinc finger domain, and a zinc binuclear cluster domain.

85. The method of embodiment 80, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

86. The method of embodiment 80, wherein the DNA-binding domain comprises a TAL effector targeting domain.

87. The method of embodiment 80, wherein the DNA-binding domain comprises three C2H2 zinc finger domains.

88. The method of embodiment 80, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 41.

89. The method of embodiment 80, wherein the second amino acid sequence comprises an amino acid sequence that is 100% identical to SEQ ID NO: 41.

90. The method of any one of embodiments 80-89, wherein the recombinant polypeptide interacts with an RNA polymerase.

91. The method of any one of embodiments 80-90, wherein the recombinant polypeptide induces RNA-directed DNA methylation.

92. The method of any one of embodiments 80-91, wherein the one or more target nucleic acids are endogenous nucleic acids.

93. The method of any one of embodiments 80-91, wherein the one or more target nucleic acids are heterologous nucleic acids.

94. The method of any one of embodiments 80-93, wherein expression of the one or more target nucleic acids is silenced.

95. A recombinant nucleic acid encoding a DMS3-like protein comprising a first amino acid sequence comprising a DNA-binding domain and a second amino acid sequence comprising a DMS3 polypeptide or a fragment thereof.

96. The recombinant nucleic acid of embodiment 95, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 41.

97. The recombinant nucleic acid of embodiment 96, wherein the second amino acid sequence comprises an amino acid sequence that is 100% identical to SEQ ID NO: 41.

98. The recombinant nucleic acid of any one of embodiments 95-97, wherein the DNA-binding domain comprises a zinc finger domain.

99. The recombinant nucleic acid of embodiment 98, wherein the zinc finger domain comprises two, three, four, five, six, seven, eight, or nine zinc fingers.

100. The recombinant nucleic acid of embodiment 98, wherein the zinc finger domain is a zinc finger array.

101. The recombinant nucleic acid of embodiment 98, wherein the zinc finger domain is selected from the group consisting of a C2H2 zinc finger domain, a CCCH zinc finger domain, a multi-cysteine zinc finger domain, and a zinc binuclear cluster domain.

102. The recombinant nucleic acid of any one of embodiments 95-97, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

103. The recombinant nucleic acid of any one of embodiments 95-97, wherein the DNA-binding domain comprises a TAL effector targeting domain.

104. The recombinant nucleic acid of any one of embodiments 95-97, wherein the DNA-binding domain binds one or more target nucleic acids.

105. The recombinant nucleic acid of embodiment 104, wherein the one or more target nucleic acids are polypeptide-encoding nucleic acids.

106. The recombinant nucleic acid of embodiment 104, wherein the one or more target nucleic acids are endogenous plant nucleic acids.

107. The recombinant nucleic acid of embodiment 104, wherein the one or more target nucleic acids are heterologous nucleic acids.

108. The recombinant nucleic acid of any one of embodiments 104-107, wherein the DMS3-like protein reduces expression of the one or more target nucleic acids.

109. The recombinant nucleic acid of any one of embodiments 104-107, wherein the DMS3-like protein silences expression of the one or more target nucleic acids.
110. A vector comprising the recombinant nucleic acid of any one of embodiments 95-109, wherein the recombinant nucleic acid is operably linked to a regulatory sequence.
111. A host cell comprising the expression vector of embodiment 110.
112. The host cell of embodiment 111, wherein the host cell is a plant cell.
113. A recombinant plant comprising the recombinant nucleic acid of any one of embodiments 95-112.
114. A method for reducing expression of one or more target nucleic acids in a plant, comprising:
    (a) providing a plant comprising a recombinant nucleic acid, wherein the recombinant nucleic acid encodes a recombinant polypeptide comprising a first amino acid sequence comprising a DNA-binding domain and a second amino acid sequence comprising a MORC6 polypeptide or a fragment thereof; and
    (b) growing the plant under conditions whereby the recombinant polypeptide encoded by the recombinant nucleic acid is expressed and binds to the one or more target nucleic acids, thereby reducing expression of the one or more target nucleic acids.
115. The method of embodiment 114, wherein the DNA-binding domain comprises a zinc finger domain.
116. The method of embodiment 115, wherein the zinc finger domain comprises two, three, four, five, six, seven, eight, or nine zinc fingers.
117. The method of embodiment 115, wherein the zinc finger domain is a zinc finger array.
118. The method of embodiment 115, wherein the zinc finger domain is selected from the group consisting of a Cys2His2 (C2H2) zinc finger domain, a CCCH zinc finger domain, a multi-cysteine zinc finger domain, and a zinc binuclear cluster domain.
119. The method of embodiment 114, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.
120. The method of embodiment 114, wherein the DNA-binding domain comprises a TAL effector targeting domain.
121. The method of embodiment 114, wherein the DNA-binding domain comprises three C2H2 zinc finger domains.
122. The method of embodiment 114, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 53.
123. The method of embodiment 114, wherein the second amino acid sequence comprises an amino acid sequence that is 100% identical to SEQ ID NO: 53.
124. The method of any one of embodiments 114-123, wherein the recombinant polypeptide interacts with an RNA polymerase.
125. The method of any one of embodiments 114-123, wherein the recombinant polypeptide induces RNA-directed DNA methylation.
126. The method of any one of embodiments 114-125, wherein the one or more target nucleic acids are endogenous nucleic acids.
127. The method of any one of embodiments 114-125, wherein the one or more target nucleic acids are heterologous nucleic acids.
128. The method of any one of embodiments 114-127, wherein expression of the one or more target nucleic acids is silenced.
129. A recombinant nucleic acid encoding a MORC6-like protein comprising a first amino acid sequence comprising a DNA-binding domain and a second amino acid sequence comprising a MORC6 polypeptide or a fragment thereof.
130. The recombinant nucleic acid of embodiment 129, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 53.
131. The recombinant nucleic acid of embodiment 130, wherein the second amino acid sequence comprises an amino acid sequence that is 100% identical to SEQ ID NO: 53.
132. The recombinant nucleic acid of any one of embodiments 129-131, wherein the DNA-binding domain comprises a zinc finger domain.
133. The recombinant nucleic acid of embodiment 132, wherein the zinc finger domain comprises two, three, four, five, six, seven, eight, or nine zinc fingers.
134. The recombinant nucleic acid of embodiment 132, wherein the zinc finger domain is a zinc finger array.
135. The recombinant nucleic acid of embodiment 132, wherein the zinc finger domain is selected from the group consisting of a C2H2 zinc finger domain, a CCCH zinc finger domain, a multi-cysteine zinc finger domain, and a zinc binuclear cluster domain.
136. The recombinant nucleic acid of any one of embodiments 129-131, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.
137. The recombinant nucleic acid of any one of embodiments 129-131, wherein the DNA-binding domain comprises a TAL effector targeting domain.
138. The recombinant nucleic acid of any one of embodiments 129-131, wherein the DNA-binding domain binds one or more target nucleic acids.
139. The recombinant nucleic acid of embodiment 138, wherein the one or more target nucleic acids are polypeptide-encoding nucleic acids.
140. The recombinant nucleic acid of embodiment 138, wherein the one or more target nucleic acids are endogenous plant nucleic acids.
141. The recombinant nucleic acid of embodiment 138, wherein the one or more target nucleic acids are heterologous nucleic acids.

142. The recombinant nucleic acid of any one of embodiments 138-141, wherein the MORC6-like protein reduces expression of the one or more target nucleic acids.

143. The recombinant nucleic acid of any one of embodiments 138-141, wherein the MORC6-like protein silences expression of the one or more target nucleic acids.

144. A vector comprising the recombinant nucleic acid of any one of embodiments 114-143, wherein the recombinant nucleic acid is operably linked to a regulatory sequence.

145. A host cell comprising the expression vector of embodiment 144.

146. The host cell of embodiment 145, wherein the host cell is a plant cell.

147. A recombinant plant comprising the recombinant nucleic acid of any one of embodiments 114-143.

148. A method for reducing expression of one or more target nucleic acids in a plant, comprising:
   (a) providing a plant comprising a recombinant nucleic acid, wherein the recombinant nucleic acid encodes a recombinant polypeptide comprising a first amino acid sequence comprising a DNA-binding domain and a second amino acid sequence comprising a SUVR2 polypeptide or a fragment thereof; and
   (b) growing the plant under conditions whereby the recombinant polypeptide encoded by the recombinant nucleic acid is expressed and binds to the one or more target nucleic acids, thereby reducing expression of the one or more target nucleic acids.

149. The method of embodiment 148, wherein the DNA-binding domain comprises a zinc finger domain.

150. The method of embodiment 149, wherein the zinc finger domain comprises two, three, four, five, six, seven, eight, or nine zinc fingers.

151. The method of embodiment 149, wherein the zinc finger domain is a zinc finger array.

152. The method of embodiment 149, wherein the zinc finger domain is selected from the group consisting of a Cys2His2 (C2H2) zinc finger domain, a CCCH zinc finger domain, a multi-cysteine zinc finger domain, and a zinc binuclear cluster domain.

153. The method of embodiment 148, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

154. The method of embodiment 148, wherein the DNA-binding domain comprises a TAL effector targeting domain.

155. The method of embodiment 148, wherein the DNA-binding domain comprises three C2H2 zinc finger domains.

156. The method of embodiment 148, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 66.

157. The method of embodiment 148, wherein the second amino acid sequence comprises an amino acid sequence that is 100% identical to SEQ ID NO: 66.

158. The method of any one of embodiments 148-157, wherein the recombinant polypeptide interacts with an RNA polymerase.

159. The method of any one of embodiments 148-157, wherein the recombinant polypeptide induces RNA-directed DNA methylation.

160. The method of any one of embodiments 148-159, wherein the one or more target nucleic acids are endogenous nucleic acids.

161. The method of any one of embodiments 148-159, wherein the one or more target nucleic acids are heterologous nucleic acids.

162. The method of any one of embodiments 148-161, wherein expression of the one or more target nucleic acids is silenced.

163. A recombinant nucleic acid encoding a SUVR2-like protein comprising a first amino acid sequence comprising a DNA-binding domain and a second amino acid sequence comprising a SUVR2 polypeptide or a fragment thereof.

164. The recombinant nucleic acid of embodiment 163, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 66.

165. The recombinant nucleic acid of embodiment 164, wherein the second amino acid sequence comprises an amino acid sequence that is 100% identical to SEQ ID NO: 66.

166. The recombinant nucleic acid of any one of embodiments 163-165, wherein the DNA-binding domain comprises a zinc finger domain.

167. The recombinant nucleic acid of embodiment 166, wherein the zinc finger domain comprises two, three, four, five, six, seven, eight, or nine zinc fingers.

168. The recombinant nucleic acid of embodiment 166, wherein the zinc finger domain is a zinc finger array.

169. The recombinant nucleic acid of embodiment 166, wherein the zinc finger domain is selected from the group consisting of a C2H2 zinc finger domain, a CCCH zinc finger domain, a multi-cysteine zinc finger domain, and a zinc binuclear cluster domain.

170. The recombinant nucleic acid of any one of embodiments 163-165, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

171. The recombinant nucleic acid of any one of embodiments 163-165, wherein the DNA-binding domain comprises a TAL effector targeting domain.

172. The recombinant nucleic acid of any one of embodiments 163-165, wherein the DNA-binding domain binds one or more target nucleic acids.

173. The recombinant nucleic acid of embodiment 172, wherein the one or more target nucleic acids are polypeptide-encoding nucleic acids.

174. The recombinant nucleic acid of embodiment 172, wherein the one or more target nucleic acids are endogenous plant nucleic acids.

175. The recombinant nucleic acid of embodiment 172, wherein the one or more target nucleic acids are heterologous nucleic acids.
176. The recombinant nucleic acid of any one of embodiments 172-175, wherein the SUVR2-like protein reduces expression of the one or more target nucleic acids.
177. The recombinant nucleic acid of any one of embodiments 172-175, wherein the SUVR2-like protein silences expression of the one or more target nucleic acids.
178. A vector comprising the recombinant nucleic acid of any one of embodiments 163-177, wherein the recombinant nucleic acid is operably linked to a regulatory sequence.
179. A host cell comprising the expression vector of embodiment 178.
180. The host cell of embodiment 179, wherein the host cell is a plant cell.
181. A recombinant plant comprising the recombinant nucleic acid of any one of embodiments 163-177.
182. A method for reducing expression of one or more target nucleic acids in a plant, comprising:
   (a) providing a plant comprising:
      a first recombinant nucleic acid encoding a first recombinant polypeptide comprising a first amino acid sequence comprising a DNA-binding domain and a second amino acid sequence comprising an SHH1 polypeptide or a fragment thereof, and
      one or more additional recombinant nucleic acids encoding one or more additional polypeptides, each of the one or more additional polypeptides comprising a first amino acid sequence comprising a DNA-binding domain and a second amino acid sequence comprising a polypeptide selected from the group consisting of a SUVH2 polypeptide or a fragment thereof, a SUVH9 polypeptide or a fragment thereof, a DMS3 polypeptide or a fragment thereof, a MORC6 polypeptide or a fragment thereof, and a SUVR2 polypeptide or a fragment thereof; and
   (b) growing the plant under conditions whereby the first recombinant polypeptide encoded by the first recombinant nucleic acid and the one or more additional polypeptides encoded by the one or more additional recombinant nucleic acids are expressed and bind to the one or more target nucleic acids, thereby reducing expression of the one or more target nucleic acids.
183. The method of embodiment 182, wherein at least one of the recombinant polypeptides induces RNA-directed DNA methylation.
184. The method of any one of embodiments 182-183, wherein the one or more target nucleic acids are endogenous nucleic acids.
185. The method of any one of embodiments 182-183, wherein the one or more target nucleic acids are heterologous nucleic acids.
186. The method of any one of embodiments 182-185, wherein expression of the one or more target nucleic acids is silenced.
187. A host cell comprising expression vectors comprising the recombinant nucleic acids encoding the recombinant polypeptides of embodiment 182.
188. The host cell of embodiment 187, wherein the host cell is a plant cell.
189. A recombinant plant comprising the recombinant nucleic acids of embodiment 182.
190. A method for reducing expression of one or more target nucleic acids in a plant, comprising:
   (a) providing a plant comprising a recombinant nucleic acid, wherein the recombinant nucleic acid encodes a recombinant polypeptide comprising a first amino acid sequence comprising a DNA-binding domain and a second amino acid sequence comprising a DRD1 polypeptide or a fragment thereof; and
   (b) growing the plant under conditions whereby the recombinant polypeptide encoded by the recombinant nucleic acid is expressed and binds to the one or more target nucleic acids, thereby reducing expression of the one or more target nucleic acids.
191. The method of embodiment 190, wherein the DNA-binding domain comprises a zinc finger domain.
192. The method of embodiment 191, wherein the zinc finger domain comprises two, three, four, five, six, seven, eight, or nine zinc fingers.
193. The method of embodiment 191, wherein the zinc finger domain is a zinc finger array.
194. The method of embodiment 191, wherein the zinc finger domain is selected from the group consisting of a Cys2His2 (C2H2) zinc finger domain, a CCCH zinc finger domain, a multi-cysteine zinc finger domain, and a zinc binuclear cluster domain.
195. The method of embodiment 190, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.
196. The method of embodiment 190, wherein the DNA-binding domain comprises a TAL effector targeting domain.
197. The method of embodiment 190, wherein the DNA-binding domain comprises three C2H2 zinc finger domains.
198. The method of embodiment 190, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 79.
199. The method of embodiment 100, wherein the second amino acid sequence comprises an amino acid sequence that is 100% identical to SEQ ID NO: 79.
200. The method of any one of embodiments 190-199, wherein the recombinant polypeptide interacts with an RNA polymerase.
201. The method of any one of embodiments 190-199, wherein the recombinant polypeptide induces RNA-directed DNA methylation.
202. The method of any one of embodiments 190-201, wherein the one or more target nucleic acids are endogenous nucleic acids.
203. The method of any one of embodiments 190-201, wherein the one or more target nucleic acids are heterologous nucleic acids.
204. The method of any one of embodiments 190-203, wherein expression of the one or more target nucleic acids is silenced.
205. A recombinant nucleic acid encoding a DRD1-like protein comprising a first amino acid sequence comprising a DNA-binding domain and a second amino acid sequence comprising a DRD1 polypeptide or a fragment thereof.

206. The recombinant nucleic acid of embodiment 205, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 79.

207. The recombinant nucleic acid of embodiment 206, wherein the second amino acid sequence comprises an amino acid sequence that is 100% identical to SEQ ID NO: 79.

208. The recombinant nucleic acid of any one of embodiments 205-207, wherein the DNA-binding domain comprises a zinc finger domain.

209. The recombinant nucleic acid of embodiment 208, wherein the zinc finger domain comprises two, three, four, five, six, seven, eight, or nine zinc fingers.

210. The recombinant nucleic acid of embodiment 208, wherein the zinc finger domain is a zinc finger array.

211. The recombinant nucleic acid of embodiment 208, wherein the zinc finger domain is selected from the group consisting of a C2H2 zinc finger domain, a CCCH zinc finger domain, a multi-cysteine zinc finger domain, and a zinc binuclear cluster domain.

212. The recombinant nucleic acid of any one of embodiments 205-207, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

213. The recombinant nucleic acid of any one of embodiments 205-207, wherein the DNA-binding domain comprises a TAL effector targeting domain.

214. The recombinant nucleic acid of any one of embodiments 205-207, wherein the DNA-binding domain binds one or more target nucleic acids.

215. The recombinant nucleic acid of embodiment 214, wherein the one or more target nucleic acids are polypeptide-encoding nucleic acids.

216. The recombinant nucleic acid of embodiment 214, wherein the one or more target nucleic acids are endogenous plant nucleic acids.

217. The recombinant nucleic acid of embodiment 214, wherein the one or more target nucleic acids are heterologous nucleic acids.

218. The recombinant nucleic acid of any one of embodiments 214-217, wherein the DRD1-like protein reduces expression of the one or more target nucleic acids.

219. The recombinant nucleic acid of any one of embodiments 214-217, wherein the DRD1-like protein silences expression of the one or more target nucleic acids.

220. A vector comprising the recombinant nucleic acid of any one of embodiments 205-219, wherein the recombinant nucleic acid is operably linked to a regulatory sequence.

221. A host cell comprising the expression vector of embodiment 220.

222. The host cell of embodiment 221, wherein the host cell is a plant cell.

223. A recombinant plant comprising the recombinant nucleic acid of any one of embodiments 205-219.

224. A method for reducing expression of one or more target nucleic acids in a plant, comprising:
 (a) providing a plant comprising a recombinant nucleic acid, wherein the recombinant nucleic acid encodes a recombinant polypeptide comprising a first amino acid sequence comprising a DNA-binding domain and a second amino acid sequence comprising an RDM1 polypeptide or a fragment thereof; and
 (b) growing the plant under conditions whereby the recombinant polypeptide encoded by the recombinant nucleic acid is expressed and binds to the one or more target nucleic acids, thereby reducing expression of the one or more target nucleic acids.

225. The method of embodiment 224, wherein the DNA-binding domain comprises a zinc finger domain.

226. The method of embodiment 225, wherein the zinc finger domain comprises two, three, four, five, six, seven, eight, or nine zinc fingers.

227. The method of embodiment 225, wherein the zinc finger domain is a zinc finger array.

228. The method of embodiment 225, wherein the zinc finger domain is selected from the group consisting of a Cys2His2 (C2H2) zinc finger domain, a CCCH zinc finger domain, a multi-cysteine zinc finger domain, and a zinc binuclear cluster domain.

229. The method of embodiment 224, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

230. The method of embodiment 224, wherein the DNA-binding domain comprises a TAL effector targeting domain.

231. The method of embodiment 224, wherein the DNA-binding domain comprises three C2H2 zinc finger domains.

232. The method of embodiment 224, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 91.

233. The method of embodiment 232, wherein the second amino acid sequence comprises an amino acid sequence that is 100% identical to SEQ ID NO: 91.

234. The method of any one of embodiments 224-233, wherein the recombinant polypeptide interacts with an RNA polymerase.

235. The method of any one of embodiments 224-233, wherein the recombinant polypeptide induces RNA-directed DNA methylation.

236. The method of any one of embodiments 224-235, wherein the one or more target nucleic acids are endogenous nucleic acids.

237. The method of any one of embodiments 224-235, wherein the one or more target nucleic acids are heterologous nucleic acids.

238. The method of any one of embodiments 224-237, wherein expression of the one or more target nucleic acids is silenced.

239. A recombinant nucleic acid encoding an RDM1-like protein comprising a first amino acid sequence comprising a DNA-binding domain and a second amino acid sequence comprising an RDM1 polypeptide or a fragment thereof.

240. The recombinant nucleic acid of embodiment 239, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 91.

241. The recombinant nucleic acid of embodiment 240, wherein the second amino acid sequence comprises an amino acid sequence that is 100% identical to SEQ ID NO: 91.

242. The recombinant nucleic acid of any one of embodiments 239-241, wherein the DNA-binding domain comprises a zinc finger domain.

243. The recombinant nucleic acid of embodiment 242, wherein the zinc finger domain comprises two, three, four, five, six, seven, eight, or nine zinc fingers.

244. The recombinant nucleic acid of embodiment 242, wherein the zinc finger domain is a zinc finger array.

245. The recombinant nucleic acid of embodiment 242, wherein the zinc finger domain is selected from the group consisting of a C2H2 zinc finger domain, a CCCH zinc finger domain, a multi-cysteine zinc finger domain, and a zinc binuclear cluster domain.

246. The recombinant nucleic acid of any one of embodiments 239-241, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

247. The recombinant nucleic acid of any one of embodiments 239-241, wherein the DNA-binding domain comprises a TAL effector targeting domain.

248. The recombinant nucleic acid of any one of embodiments 239-241, wherein the DNA-binding domain binds one or more target nucleic acids.

249. The recombinant nucleic acid of embodiment 248, wherein the one or more target nucleic acids are polypeptide-encoding nucleic acids.

250. The recombinant nucleic acid of embodiment 248, wherein the one or more target nucleic acids are endogenous plant nucleic acids.

251. The recombinant nucleic acid of embodiment 248, wherein the one or more target nucleic acids are heterologous nucleic acids.

252. The recombinant nucleic acid of any one of embodiments 248-251, wherein the RDM1-like protein reduces expression of the one or more target nucleic acids.

253. The recombinant nucleic acid of any one of embodiments 248-251, wherein the RDM1-like protein silences expression of the one or more target nucleic acids.

254. A vector comprising the recombinant nucleic acid of any one of embodiments 239-253, wherein the recombinant nucleic acid is operably linked to a regulatory sequence.

255. A host cell comprising the expression vector of embodiment 254.

256. The host cell of embodiment 255, wherein the host cell is a plant cell.

257. A recombinant plant comprising the recombinant nucleic acid of any one of embodiments 239-253.

258. A method for reducing expression of one or more target nucleic acids in a plant, comprising:
(a) providing a plant comprising a recombinant nucleic acid, wherein the recombinant nucleic acid encodes a recombinant polypeptide comprising a first amino acid sequence comprising a DNA-binding domain and a second amino acid sequence comprising a DRM3 polypeptide or a fragment thereof; and
(b) growing the plant under conditions whereby the recombinant polypeptide encoded by the recombinant nucleic acid is expressed and binds to the one or more target nucleic acids, thereby reducing expression of the one or more target nucleic acids.

259. The method of embodiment 258, wherein the DNA-binding domain comprises a zinc finger domain.

260. The method of embodiment 259, wherein the zinc finger domain comprises two, three, four, five, six, seven, eight, or nine zinc fingers.

261. The method of embodiment 259, wherein the zinc finger domain is a zinc finger array.

262. The method of embodiment 259, wherein the zinc finger domain is selected from the group consisting of a Cys2His2 (C2H2) zinc finger domain, a CCCH zinc finger domain, a multi-cysteine zinc finger domain, and a zinc binuclear cluster domain.

263. The method of embodiment 258, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

264. The method of embodiment 258, wherein the DNA-binding domain comprises a TAL effector targeting domain.

265. The method of embodiment 258, wherein the DNA-binding domain comprises three C2H2 zinc finger domains.

266. The method of embodiment 258, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 101.

267. The method of embodiment 266, wherein the second amino acid sequence comprises an amino acid sequence that is 100% identical to SEQ ID NO: 101.

268. The method of any one of embodiments 258-267, wherein the recombinant polypeptide interacts with an RNA polymerase.

269. The method of any one of embodiments 258-267, wherein the recombinant polypeptide induces RNA-directed DNA methylation.

270. The method of any one of embodiments 258-269, wherein the one or more target nucleic acids are endogenous nucleic acids.

271. The method of any one of embodiments 258-269, wherein the one or more target nucleic acids are heterologous nucleic acids.

272. The method of any one of embodiments 258-271, wherein expression of the one or more target nucleic acids is silenced.

273. A recombinant nucleic acid encoding a DRM3-like protein comprising a first amino acid sequence comprising a DNA-binding domain and a second amino acid sequence comprising a DRM3 polypeptide or a fragment thereof.

274. The recombinant nucleic acid of embodiment 273, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 101.

275. The recombinant nucleic acid of embodiment 274, wherein the second amino acid sequence comprises an amino acid sequence that is 100% identical to SEQ ID NO: 101.

276. The recombinant nucleic acid of any one of embodiments 273-275, wherein the DNA-binding domain comprises a zinc finger domain.

277. The recombinant nucleic acid of embodiment 276, wherein the zinc finger domain comprises two, three, four, five, six, seven, eight, or nine zinc fingers.

278. The recombinant nucleic acid of embodiment 276, wherein the zinc finger domain is a zinc finger array.

279. The recombinant nucleic acid of embodiment 276, wherein the zinc finger domain is selected from the group consisting of a C2H2 zinc finger domain, a CCCH zinc finger domain, a multi-cysteine zinc finger domain, and a zinc binuclear cluster domain.

280. The recombinant nucleic acid of any one of embodiments 273-275, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

281. The recombinant nucleic acid of any one of embodiments 273-275, wherein the DNA-binding domain comprises a TAL effector targeting domain.

282. The recombinant nucleic acid of any one of embodiments 273-275, wherein the DNA-binding domain binds one or more target nucleic acids.

283. The recombinant nucleic acid of embodiment 282, wherein the one or more target nucleic acids are polypeptide-encoding nucleic acids.

284. The recombinant nucleic acid of embodiment 282, wherein the one or more target nucleic acids are endogenous plant nucleic acids.

285. The recombinant nucleic acid of embodiment 282, wherein the one or more target nucleic acids are heterologous nucleic acids.

286. The recombinant nucleic acid of any one of embodiments 282-285, wherein the DRM3-like protein reduces expression of the one or more target nucleic acids.

287. The recombinant nucleic acid of any one of embodiments 282-285, wherein the DRM3-like protein silences expression of the one or more target nucleic acids.

288. A vector comprising the recombinant nucleic acid of any one of embodiments 273-287, wherein the recombinant nucleic acid is operably linked to a regulatory sequence.

289. A host cell comprising the expression vector of embodiment 288.

290. The host cell of embodiment 289, wherein the host cell is a plant cell.

291. A recombinant plant comprising the recombinant nucleic acid of any one of embodiments 273-287.

292. A method for reducing expression of one or more target nucleic acids in a plant, comprising:
  (a) providing a plant comprising a recombinant nucleic acid, wherein the recombinant nucleic acid encodes a recombinant polypeptide comprising a first amino acid sequence comprising a DNA-binding domain and a second amino acid sequence comprising a DRM2 polypeptide or a fragment thereof; and
  (b) growing the plant under conditions whereby the recombinant polypeptide encoded by the recombinant nucleic acid is expressed and binds to the one or more target nucleic acids, thereby reducing expression of the one or more target nucleic acids.

293. The method of embodiment 292, wherein the DNA-binding domain comprises a zinc finger domain.

294. The method of embodiment 293, wherein the zinc finger domain comprises two, three, four, five, six, seven, eight, or nine zinc fingers.

295. The method of embodiment 293, wherein the zinc finger domain is a zinc finger array.

296. The method of embodiment 293, wherein the zinc finger domain is selected from the group consisting of a Cys2His2 (C2H2) zinc finger domain, a CCCH zinc finger domain, a multi-cysteine zinc finger domain, and a zinc binuclear cluster domain.

297. The method of embodiment 292, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

298. The method of embodiment 292, wherein the DNA-binding domain comprises a TAL effector targeting domain.

299. The method of embodiment 292, wherein the DNA-binding domain comprises three C2H2 zinc finger domains.

300. The method of embodiment 292, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 113.

301. The method of embodiment 300, wherein the second amino acid sequence comprises an amino acid sequence that is 100% identical to SEQ ID NO: 113.

302. The method of any one of embodiments 292-301, wherein the recombinant polypeptide interacts with an RNA polymerase.

303. The method of any one of embodiments 292-301, wherein the recombinant polypeptide induces RNA-directed DNA methylation.

304. The method of any one of embodiments 292-303, wherein the one or more target nucleic acids are endogenous nucleic acids.

305. The method of any one of embodiments 292-303, wherein the one or more target nucleic acids are heterologous nucleic acids.
306. The method of any one of embodiments 292-305, wherein expression of the one or more target nucleic acids is silenced.
307. A recombinant nucleic acid encoding a DRM2-like protein comprising a first amino acid sequence comprising a DNA-binding domain and a second amino acid sequence comprising a DRM2 polypeptide or a fragment thereof.
308. The recombinant nucleic acid of embodiment 307, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 113.
309. The recombinant nucleic acid of embodiment 308, wherein the second amino acid sequence comprises an amino acid sequence that is 100% identical to SEQ ID NO: 113.
310. The recombinant nucleic acid of any one of embodiments 307-309, wherein the DNA-binding domain comprises a zinc finger domain.
311. The recombinant nucleic acid of embodiment 310, wherein the zinc finger domain comprises two, three, four, five, six, seven, eight, or nine zinc fingers.
312. The recombinant nucleic acid of embodiment 310, wherein the zinc finger domain is a zinc finger array.
313. The recombinant nucleic acid of embodiment 310, wherein the zinc finger domain is selected from the group consisting of a C2H2 zinc finger domain, a CCCH zinc finger domain, a multi-cysteine zinc finger domain, and a zinc binuclear cluster domain.
314. The recombinant nucleic acid of any one of embodiments 307-309, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.
315. The recombinant nucleic acid of any one of embodiments 307-309, wherein the DNA-binding domain comprises a TAL effector targeting domain.
316. The recombinant nucleic acid of any one of embodiments 307-309, wherein the DNA-binding domain binds one or more target nucleic acids.
317. The recombinant nucleic acid of embodiment 316, wherein the one or more target nucleic acids are polypeptide-encoding nucleic acids.
318. The recombinant nucleic acid of embodiment 316, wherein the one or more target nucleic acids are endogenous plant nucleic acids.
319. The recombinant nucleic acid of embodiment 316, wherein the one or more target nucleic acids are heterologous nucleic acids.
320. The recombinant nucleic acid of any one of embodiments 316-319, wherein the DRM2-like protein reduces expression of the one or more target nucleic acids.
321. The recombinant nucleic acid of any one of embodiments 316-319, wherein the DRM2-like protein silences expression of the one or more target nucleic acids.
322. A vector comprising the recombinant nucleic acid of any one of embodiments 307-321, wherein the recombinant nucleic acid is operably linked to a regulatory sequence.
323. A host cell comprising the expression vector of embodiment 322.
324. The host cell of embodiment 323, wherein the host cell is a plant cell.
325. A recombinant plant comprising the recombinant nucleic acid of any one of embodiments 307-321.
326. A method for reducing expression of one or more target nucleic acids in a plant, comprising:
    (a) providing a plant comprising a recombinant nucleic acid, wherein the recombinant nucleic acid encodes a recombinant polypeptide comprising a first amino acid sequence comprising a DNA-binding domain and a second amino acid sequence comprising an FRG polypeptide or a fragment thereof; and
    (b) growing the plant under conditions whereby the recombinant polypeptide encoded by the recombinant nucleic acid is expressed and binds to the one or more target nucleic acids, thereby reducing expression of the one or more target nucleic acids.
327. The method of embodiment 326, wherein the DNA-binding domain comprises a zinc finger domain.
328. The method of embodiment 327, wherein the zinc finger domain comprises two, three, four, five, six, seven, eight, or nine zinc fingers.
329. The method of embodiment 327, wherein the zinc finger domain is a zinc finger array.
330. The method of embodiment 327, wherein the zinc finger domain is selected from the group consisting of a Cys2His2 (C2H2) zinc finger domain, a CCCH zinc finger domain, a multi-cysteine zinc finger domain, and a zinc binuclear cluster domain.
331. The method of embodiment 326, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.
332. The method of embodiment 326, wherein the DNA-binding domain comprises a TAL effector targeting domain.
333. The method of embodiment 326, wherein the DNA-binding domain comprises three C2H2 zinc finger domains.
334. The method of embodiment 326, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 125.
335. The method of embodiment 334, wherein the second amino acid sequence comprises an amino acid sequence that is 100% identical to SEQ ID NO: 125.
336. The method of any one of embodiments 326-335, wherein the recombinant polypeptide interacts with an RNA polymerase.
337. The method of any one of embodiments 326-335, wherein the recombinant polypeptide induces RNA-directed DNA methylation.

338. The method of any one of embodiments 326-337, wherein the one or more target nucleic acids are endogenous nucleic acids.
339. The method of any one of embodiments 326-337, wherein the one or more target nucleic acids are heterologous nucleic acids.
340. The method of any one of embodiments 326-339, wherein expression of the one or more target nucleic acids is silenced.
341. A recombinant nucleic acid encoding an FRG-like protein comprising a first amino acid sequence comprising a DNA-binding domain and a second amino acid sequence comprising a FRG polypeptide or a fragment thereof.
342. The recombinant nucleic acid of embodiment 341, wherein the second amino acid sequence comprises an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to SEQ ID NO: 125.
343. The recombinant nucleic acid of embodiment 342, wherein the second amino acid sequence comprises an amino acid sequence that is 100% identical to SEQ ID NO: 125.
344. The recombinant nucleic acid of any one of embodiments 341-343, wherein the DNA-binding domain comprises a zinc finger domain.
345. The recombinant nucleic acid of embodiment 344, wherein the zinc finger domain comprises two, three, four, five, six, seven, eight, or nine zinc fingers.
346. The recombinant nucleic acid of embodiment 344, wherein the zinc finger domain is a zinc finger array.
347. The recombinant nucleic acid of embodiment 344, wherein the zinc finger domain is selected from the group consisting of a C2H2 zinc finger domain, a CCCH zinc finger domain, a multi-cysteine zinc finger domain, and a zinc binuclear cluster domain.
348. The recombinant nucleic acid of any one of embodiments 341-343, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.
349. The recombinant nucleic acid of any one of embodiments 341-343, wherein the DNA-binding domain comprises a TAL effector targeting domain.
350. The recombinant nucleic acid of any one of embodiments 341-343, wherein the DNA-binding domain binds one or more target nucleic acids.
351. The recombinant nucleic acid of embodiment 350, wherein the one or more target nucleic acids are polypeptide-encoding nucleic acids.
352. The recombinant nucleic acid of embodiment 350, wherein the one or more target nucleic acids are endogenous plant nucleic acids.
353. The recombinant nucleic acid of embodiment 350, wherein the one or more target nucleic acids are heterologous nucleic acids.
354. The recombinant nucleic acid of any one of embodiments 350-353, wherein the FRG-like protein reduces expression of the one or more target nucleic acids.
355. The recombinant nucleic acid of any one of embodiments 350-353, wherein the FRG-like protein silences expression of the one or more target nucleic acids.
356. A vector comprising the recombinant nucleic acid of any one of embodiments 341-355, wherein the recombinant nucleic acid is operably linked to a regulatory sequence.
357. A host cell comprising the expression vector of embodiment 356.
358. The host cell of embodiment 357, wherein the host cell is a plant cell.
359. A recombinant plant comprising the recombinant nucleic acid of any one of embodiments 341-355.
360. A method for reducing expression of one or more target nucleic acids in a plant, comprising:
(a) providing a plant comprising:
a first recombinant nucleic acid encoding a first recombinant polypeptide comprising a first amino acid sequence comprising a DNA-binding domain and a second amino acid sequence comprising an SHH1 polypeptide or a fragment thereof, and
one or more additional recombinant nucleic acids encoding one or more additional polypeptides, each of the one or more additional polypeptides comprising a first amino acid sequence comprising a DNA-binding domain and a second amino acid sequence comprising a polypeptide selected from the group consisting of a SUVH2 polypeptide or a fragment thereof, a SUVH9 polypeptide or a fragment thereof, a DMS3 polypeptide or a fragment thereof, a MORC6 polypeptide or a fragment thereof, a SUVR2 polypeptide or a fragment thereof, a DRD1 polypeptide or a fragment thereof; an RDM1 polypeptide or a fragment thereof; a DRM3 polypeptide or a fragment thereof; a DRM2 polypeptide or a fragment thereof; and an FRG polypeptide or a fragment thereof, and
(b) growing the plant under conditions whereby the first recombinant polypeptide encoded by the first recombinant nucleic acid and the one or more additional polypeptides encoded by the one or more additional recombinant nucleic acids are expressed and bind to the one or more target nucleic acids, thereby reducing expression of the one or more target nucleic acids.
361. The method of embodiment 360, wherein at least one of the recombinant polypeptides induces RNA-directed DNA methylation.
362. The method of any one of embodiments 360-361, wherein the one or more target nucleic acids are endogenous nucleic acids.
363. The method of any one of embodiments 360-361, wherein the one or more target nucleic acids are heterologous nucleic acids.
364. The method of any one of embodiments 360-363, wherein expression of the one or more target nucleic acids is silenced.
365. A host cell comprising expression vectors comprising the recombinant nucleic acids encoding the recombinant polypeptides of embodiment 360.
366. The host cell of embodiment 365, wherein the host cell is a plant cell.
367. A recombinant plant comprising the recombinant nucleic acids of embodiment 360.
368. A plant having reduced expression of one or more target nucleic acids as a consequence of the method of any one of embodiments 1-17, 37-53, 80-94, 114-128, 148-162, 190-204, 224-238, 258-272, 292-306, and 326-340.

369. A progeny plant of the plant of embodiment 368.
370. The progeny plant of embodiment 369, wherein the progeny plant has reduced expression of the one or more target nucleic acids and does not comprise the recombinant nucleic acid.
371. A plant having reduced expression of one or more target nucleic acids as a consequence of the method of any one of embodiments 72-76.
372. A progeny plant of the plant of embodiment 371.
373. The progeny plant of embodiment 372, wherein the progeny plant has reduced expression of the one or more target nucleic acids and does not comprise the first or second recombinant nucleic acids.
374. A plant having reduced expression of one or more target nucleic acids as a consequence of the method of any one of embodiments 182-186 and 360-364.
375. A progeny plant of the plant of embodiment 374.
376. The progeny plant of embodiment 375, wherein the progeny plant has reduced expression of the one or more target nucleic acids and does not comprise the first recombinant nucleic acid or the one or more additional recombinant nucleic acids.

SEQUENCE LISTING (184 sequences)

SEQ ID NO: 1 - protein, 258 aa, Arabidopsis thaliana
MAASDDSSHYFTEFTLSEIVDMENLYKELGDQSLHKDFCQTVASTFSCSVNRNGKSSITWKQVQIWFQEKLKHQSQPKSKTLPSPPLQIHDLSNPSSYASNASNATFVGNSTFVQTRKGKASDLADLAFEAKSARDYAWYDVSSFLTYRVLRTGELEVRVRFSGFDNRHDEWVNVKTSVRERSIPVEPSECGRVNVGDLLLCFQEREDQALYCDGHVLNIKRGIHDHARCNCVFLVRYELDNTEESLGLERICRRPEE

SEQ ID NO: 2 - protein, 285 aa, Ricinus communis
MTASHELGGHRRPHTRETLETSLTTTQNPVNIAKQKAQSLFWLVMGSPSEFTLAEMVEMENIYKELGEESLDSEFCERLATSFSFTANRAGKPAITWEQVQSWFEDRQKESRPRVSPSPLSLKLFVDLSNAKISSDAPESSRNSKGKVTDLSELIFEARSSRDNAWYDVAAFLNYRVLSTGELEARVRFSGFRNTDDEWVNVKRAVRERSIPLEPSECHRVKVGDLVLCFRERFDQAVYCDAHVVGIQRRPHEAASCRCIFVVRYDHDNTEEAAQLERLCCRPTQ

SEQ ID NO: 3 - protein, 273 aa, Glycine max
MEKLPLTEYPFPKLSLDEILELERIYKDVVGKVFNRKLCQEIAKRFSSSSNGAGKNSLSWQQVQLWFRNSQRMLLGEDISSSDLLKISADLADSPLLGNGKGKQATDLDDMGFEARSTKDNAWHDVSMFLNYRVLSTGELEVRVRYAGFGKEQDEWMNVKLGVRERSIPLEPSECHKVKDGDLVLCFLEKEDYALYCDARIVKIQRKIHDPTDCTCTFIVQFVHDNTEEGVSFSRICCRPTQEESACFPDLALDPTQSPSLNFPLNTIESLWG

SEQ ID NO: 4 - protein, 381 aa, Zea mays
MGRPPSTTGAPAFRFLPSEVAEMEARLLQLNNGIPTRAMLQTLADKFSASPERAGKVAIQPKQVWNWFQNRRYSHRAKTTRVVPSPPAKMPSGADHHQHAANASAFRAAQPSSVAVAHHGSSSTGKNPMEGVSVEFEAKSARDGAWYDVAAFLSHRLFESGDPEVRVRFSGFGAEEDEWINVRKCVRQRSLPCEATECVAVLPGDLILCFQEDKEQALYFDARVLDAQRRRHDVRGCRCRFLVRYDHDSSEEIVPLRKVCRRPETDYRLQILHAARAAAASADIHTPPREAKVELASNAKSPYEQKPQKQYKMMDVNTDEEVTMVSTLEQDETQGKTVAPVPSATAETRNSSSDAVMKDAEASSVAQDDDEVQVVDKMKEG

SEQ ID NO: 5 - protein, 270 aa, Medicago truncatula
MKELTSNESPFPKLSLDEILELERIYNDVGEKSLDPNFCKDIAANFSSSSNSDGKTSLTWEQVQQWLQNKHTETKGHFASSPEGLNLVVDLSGKSSSIKGNKSSPKPKGIQAADLSELAFEAVSIKDNAWHDVSMFLNYRVLCTGELEVRVRYHGFGKDEDEWINVKYGVRQRSIPLEASECHKVKEGHLVLCFHVKSDYALYCDAIVLKIQRREHDSEECSCIFTVRFYHDKFEEEVRWDSLCCRPTQEESEVPFELEPTMNPIANLWG

SEQ ID NO: 6 - protein, 274 aa, Physcomitrella patens
MGRTPMSGGTAFRFLPAEVADMEKALDASNGATPARSIVETLADKFTNSSERSGQRPVQWKQQVWNWFQNRRHAQKAKIDKLKGVGPGGETPSAAKSVVIMLVTVRLCILVDRVNVITGAAKKPNVHVPMDFEAKSARDGAWYVYDVSAFINKRTGENGEPEVRVRFAGFGSEEDEWVNIATAVRQRSLPCETTECVAVLPGDLILCFQEGSEQALYFDADILDVQRRRHDVRGCRCRFWVRYRHDQTEVEVVPLRKVCRRPETEQRLQQAREA

SEQ ID NO: 7 - protein, 381 aa, Sorghum bicolor
MGRPPSTTGAPAFRFLPSEVAEMEARLQQLNNGIPSRGVLQTLADKFSASPERAGKVAIQPKQVWNWFQNRRYSHRAKSTRAVPSPPAKMTPSGADHHQHAANASAFRAAQPSSVAAAHHGASPTGKNPVEGVSVEFEAKSARDGAWYDVAAFLSQRLFETGEPEVRVRFSGFGAEEDEWINVRKCVRQRSLPCEATECVAVLPGDLILCFQEGKEQALYFDARVLDAQRRRHDVRGCRCRFLVRYDHDSSEEIVPLRKVCRRPDTDYRLQILHAARVAATNADIHTPPKEIKVELTSNDKSPTEQKPQKQHKMMDVNTDEVTMVSTLEQDETQGKTVAPLPSSTVETRNSSSDAVMKDAEASSVVEDDDEVQVVDKMKEG

SEQ ID NO: 8 - protein, 269 aa, Oryza sativa
MERRSSVRFAPSEIARMEKLVTHKKEQVLDEIFCRKLAEEFNCSPGRVGSKALQAVQVQEWFRQKFPASTVIPPCLPTGSEEKALASQASAPVSEEKPPSSEENALAVDTSISNDIGEVSPDLPIDNIDKLPEIEDMQFEARSSKDFAWYDIATFLAYRKLSSGEFEVRVRFQGFGAEEDEWINVRKAIRLQSIPLESSECKLIREGDLVLCFKESNDEALHFDAHVLEIQRKQHDIRGCRCVFLVEYDHDGTQERVNLRRLSRRPKHS

SEQ ID NO: 9 - protein, 360 aa, Brachypodium distachyon
MGRPPSSGGPAFRFTHAEVAEMEEHLRHLNNAIPHRDVIQGLADKFTASPARAGKISVQPKQVWNWFQNRRYSQRNRTTRGAPLPQGKMLPTGAADEHHSASFGAQSASSVYPTGKNSSNGGQVDFEAKSARDGAWYDVAHFLSHRLFETGEPEVRVRFSGFGAEEDEWINVRKCVRQRSLPCEPTECVAVLPGDLILCFQEGKEQALYFDARILDAQRRRHDVRGCRCRFLVRYDHDHSEEIVPLRKVCRRPDNGFRQHILHANRVAASAQDVHMGIQIDRSSAEQKPQKPHKMMDVNTDEVTMVPKVEPTDKPVVSLPAASISTRGDSSSDVTMKDAGATPEVEAADEGQGDKMNAGE

SEQ ID NO: 10 - protein, 239 aa, Populus trichocarpa
MDFEFTLSEMLEMENMFKELEEGPLAPQFCEKLASSFSLAPSRDGKQAITPRQVKSWFQDRLKKSQPRVASSNMALKLFADLSDASASFGATESSQKLKGNASDLSELIFEALSSKDNAWYDVASFLNYRVVCSGELEVRVRFAGFRNTDDEWVNVRRAVRERSIPLESSECQRVKVGDLVLCFQEREERAVYCDAHIVEINRKLHDINGCRCTFVVRYDHDDFEEEVRLDRLCGRPTP

SEQ ID NO: 11 - protein, 247 aa, Vitis vinifera
MDDAPVPIACFTQSEILEMENLFEEFGEETLGQEFCQDLATSFSASPGCSGNMPVGWKEVRDWFQTKQKELVARVTSSPVAPRGIDALPEAPMSNNAPQNSIVPRGDMVAADLSELTYEAKSSKDDAWYDVAAFLTYRVLSSGELEARVRFSGFGNEEDEWVNVKKGIRKRSIPLEPSECYRVRVGDLVLCFQERSDQAVYCDAHIIEIQRRLHDIKGCRCIFVVRYDHDHGEEKVNLKRLCCRPTL

SEQ ID NO: 12 - protein, 279 aa, Cucumis sativus
MEHRKSSKLLDDSSFEFTLAEIVEMDNILKDSRDQTLGQEFFQDVALHFSCSPWRAAKSPVTTEHVHAWFENRRKELRASSKKARPPPPPPSELPPLPTPSSPPPSPPPKLLLYHSESDFLTHAPSSGPPEFKGKATDLSELAFEAFSSRDHAWYDVASFLTYRVNCHGELDARVRYAGFTKDEDEWVNVGRGVRDRSIPLESSECYRVKVGDLVLCFQERQDHALYFDAHVVEIQRRLHDIGGCRCIFVVRYEHDRHEEKVHIGRLCCRPSAFSSDQI

SEQ ID NO: 13 - protein, 276 aa, Arabidopsis lyrata
MAAPDDSSHYFTEFTLAEIRDSCFVILLYCSSSAKIVDMENLYKELGDQSLHKDFCQTVASTFSFMSSSIVSQSCSVNRNGKSTVTWKQIQSWFQEKLKQQSQPKFKTLPSPPLQIHDLSNPSCYAANATFVQTRKGKASDLADLAFEAKSARDYAWYDVSSFLTYRVLRTGELEVRVRFSGFDNRHDEWVNVKTSVRERSIPLEPSECGRVNIGDLLLCFQERDDQALYCDGHVVNIKRGIHDHRRCNCVFLVRYDLDNTEEPLGLEKICRRPDE

SEQ ID NO: 14 - protein, 651 aa, Arabidopsis thaliana
MSTLLPFPDLNLMPDSQSSTAGTTAGDTVVTGKLEVKSEPIEEWQTPPSSTSDQSANTDLIAEFIRISELFRSAFKPLQVKGLDGVSVYGLDSGAIVAVPEKENRELIEPPPGFKDNRVSTVVVSPKFERPRELARIAILGHEQRKELRQVMKRTRMTYESLRIHLMAESMKNHVLGQGRRRRSDMAAAYIMRDRGLWLNYDKHIVGPVTGVEVGDIFFYRMELCVLGLHGQTQAGIDCLTAERSATGEPIATSIVVSGGYEDDEDTGDVLVYTGHGGQDHQHKQCDNQRLVGGNLGMERSMHYGIEVRVIRGIKYENSISSKVYVYDGLYKIVDWWFAVGKSGFGVFKFRLVRIEGQPMMGSAVMRFAQTLRNKPSMVRPTGYVSFDLSNKKENVPVFLYNDVDGDQEPRHYEYIAKAVFPPGIFGQGGISRTGCECKLSCTDDCLCARKNGGEFAYDDNGHLLKGKHVVFECGEFCTCGPSCKSRVTQKGLRNRLEVFRSKETGWGVRTLDLIEAGAFICEYAGVVVTRLQAEILSMNGDVMVYPGRFTDQWRNWGDLSQVYPDFVRPNYPSLPPLDFSMDVSRMRNVACYISHSKEPNVMVQFVLHDHNHLMFPRVMLFALENISPLAELSLDYGLADEVNGKLAICN

SEQ ID NO: 15 - protein, 364 aa, Ricinus communis
MHQKLEGGNLALERSMHYGIEVRVIRGFKYAGSFTNKIYVYDGLYKIHDCWFDVGKSGFGVYKYKLMRIVGQPEMGSSVLRFAQSLRTAPLSVRPRGYLSLDISNKKENMPIMLFNDIDNDHDPLCYEYLARTVFPPFAFNQGSSGTGCECIGGCVDGCLCSMKNGGEFAYDQNGFLLRGKPLVFECGAFCKCPPSCRNRVSQKGLKNRLEVFRSRETGWGVRSLDLIHAGEFICEYAGVILTKDQAQVFTMNGDSLIYPNRFSPKWAEWGDLSQIYADYVRPTYPSVPPLDVAMDVSRMRNVACYLSHSSTPNAMVQYVLFDHNNLMFPHLMLFALENIPPLREISLDYGVADEWTGKLSICN

SEQ ID NO: 16 - protein, 709 aa, Glycine max
MNFLFSRENLPPPPGIPIPATIAAANTTPNPILIPKLEPFDELLNTHTPQQQQQSQDPSFSNGSLDLDLDLDLKLVCDETPGAFSGDPSLLSDFNRLSQLFKTAFTNNNAVLDPIAQGLQQLQNDAVSDPLDGTTVVPPQSFQNSDPGMQQQQQYPNGAVSDPDSRAIVPVPEEGRSSSVAVTTPRQRRFKELVRLTDVGGPEQRHFRDVVRRTRMVYDSLRVLATVEDEGRVDARRGRSDLRASAVMRNCGLWLNRDKRIVGAIPGVCIGDVFLYRMELCVVGLHGQPQAGIDYLPASMSSNGEPIATSVIVSGGYEDDVDEGDVIIYSGHGGQDKHSRQVFHQKLEGGNLAMERSMHYGIEVRVIRGVRYEGAASATGRLYVYDGLYRIHECWFDVGKSGFGVYKYKLCRIDGQAKMGTVVMKEALMLRKDPLSFKPTCCLSLDVSNRKENVAVRLFNDIDPNYDPLQYEYLVKTNFPQFVFHQSGRGTGCECADGCVEGCFCAMKNGGDFPYNQSGILLRGKPLVFECGPFCRCPPHCRNRVTQKGLKNRLEVFRSRETGWGVRSMDLIQAGAFICEYTGVVLTREQARLLTMNGDSLIYPNRFTDRWAEWGDLSMIDSNFVRPSYPSIPPLDFAMDVSRMRNVACYMSHSSTPNVLVQFVLYDHNNLMFPRLMLFAMESIPPMRELSLDYGVADEWTGKLSICNE

SEQ ID NO: 17 - protein, 682 aa, Zea mays
MDVVESSPSSSPISSPAGSSESIDLNFLPFLKREPKSEPASPELGPLPLPAPPTQTPQQQHAAAPAPEATAPLSPATPDLSSAPVMAPLQSLPPNLDEDALLREYYRLAGLYLSSARSGAIIPALAPEAAAPAVVQSGSGSVVKKRRPRSSDLVRVSSLGVQDQIYFRDLVRRARITFECLRGLLLRDDERAESLGLAAVAGFGVARDRRRVRADLRAAALMGDHDLWLNRDRRIVGPMPGISVGDAFFFRMELCVLGLHGQVQAGIDYVSAGRSASGEPIATSIIVSGGYEDDDDHGDVLVYTGHGGRDPNLHKHCVDQKLEGGNLALERSMAYGIEIRVIRAVKSRRSPVGKVYFYDGLYKVVDYWLDRGKSGFGVYKYRLLRIEGQEPMGSVNYRVAEQLKVDVFAIRPTGYLSFDISMGRDTLSVALFNDVDDDQDPLLFEYLARPIFPTSAVQGKFAEGGGGGCDCAEICSIGCNCAGRNGGEFAYDRTGTLLRGKPLVYECGPYCRCPPSCPNRVSQKGLQHRLEVFRSRETGWGVRSLDLIKAGTFICEFSGIILTHQQSEVVAANGDCLVRPSRFPPRWLDWGDISDVYPDYVAPDHPSIPELKFAIDVSRARNVACYFSHSCSPNVFVQFVLFDHYNVSYPHLMIFAMENIPPLRELSIDYGMVDEWIGQLTM

SEQ ID NO: 18 - protein, 570 aa, Medicago truncatula
MNFQDPNPSISRTIVPIPNELQNYDNNTLTGKDSKSKQKLRGQNKELVHTVMDADHRPYREMVRRTRILFDSIRVSGLLEEENNRKNKKNLKASSLVNQTEEVNNSRVRNDLIAATLMKDHGMYLYHDVKIIGTVPGVSIGDIFLYRSEMCVIGLHGQPQAGIDYLHASMSSNGQPIATSVVVSDGYNDDDQGDSIIYSGHGDMKQDQKLERGNLAMVTSMQYEIDVRVIRGFRYEGATSTTSSKVFVYDGLYKIIEFWFEKGISGFGVYKFMLSRVQGQPKMGSMILKEASMLMRGHLCDNHMCVLSDDISNGKENIGVRLYNDIDSDLYPMQFEYLPKAAFPMFLLPQSMTTRKKMRVIECSECVDGCVSSIMNGNTTPYSKSGILLKGRSLIYECGPFCSCPSHCRNRVTQKGIKYRLEVFRSNETSWGVRSLDPILAGTFICEFTGLVLTREQAEILTMDGEHNSLIIYPNRFLNRSTQEWGDLSMIDANHVHPAYPTLDFALDVSMMRNVASYISHSPTPNVFVQLVLFDHGNWMFPHLMVFAMENIPPMRELSLDHGVEARVID

SEQ ID NO: 19 - protein, 533 aa, Physcomitrella patens
MNFEASLNDEAQPNDLDSELYRQRRKRYADLLHFYQQLQEKGESNERIRPDLEATKKMQEEKMNFDWKGVGHVPGSIVGDFFFYRTELFVLGLHRAMQAGIAYTEVGQEKIGCSIVASGGYEDDEDHGETMIYTGHGGNNKADRRQVKDQKPEGGNLALLNSLKYKQPVRVIRGHSDIPTSQSPSKKIYSYDGLYQVVDQSLELGASGFKVFKFKLERLPNQRELGSRLVSFVGKLNKAPSIRTGVVIEDLSGGQEPIPVSVVNTVDDTRPPSSFEYTTKLRYPKGVSLRSSTGCSCKGDSCHSVGHRCSCVLKNSGKMLPYNQYGHLIRAVPAVYECGSRCKCSLECHNRVCQKGLRYRLEIFKTEKKGWAVRSWDFIPSGGFVCEYTGVIMDTKTADELDDDDYLFNLDFKQGNEARWGVQRSDVFDSDDSDMPPLKLSSPKYVIDASKFGGVARFVNHSCTPNLFVQCVLYDHGDLDLPHVMLFAGSDISPFQELTYDYGYALNSVYDSHGNLKKKDCHCGTRSCRKRLY

SEQ ID NO: 20 - protein, 710 aa, Sorghum bicolor
MRREGLGNFGVEEEEAREDGQGSLFMEMDVEESSPSSSLMSSPAGSSDSIDLNFLPFLKREPKSEPGSPELGPLPLPTQTPPPQHAAAPAPAPAPEASVPLPPATPDLSSAPVMAPLQSLPPNQDVDAVLQEYYRLASLYVSSTGSGAIVPAPAPEATAPAVVQSASGSVVKKRRPRSSDLVRVSSLGVQDQIYFRDLVRRARITFECLRGLLLRDDERAESLGLPGVAGFGVARERRRVRADLRAAAIMADHDLWLNRDRRIVGPLPGISVGDAFFFRMELCVLGLHGQVQAGIDYVSAGRSASGEPIATSIIVSGGYEDDDDHGDVLVYTGHGGRDPNLHKHCVDQKLEGGNLALERSMAYGIEIRVIRAVKSRRSPVGKVYFYDGLYKVVDYWLDRGKSGFGVYKYRMLRIEGQEPMGTVNYQVAEQLKVDVLAIRPTGYLSFDISMGRETLPVALFNDVDDDQDPLLFEYLARPIFPTSAVQGKFAEGGGGGCDCAGICSIGCNCAGRNGGEFAYDKTGTLLRGKPLVYECGPYCRCPPSCPNRVSQKGLQHKLEVFRSRETGWGVRSLDLIKAGTFICEFSGIVLTHQQSEIVAANGDCLVRPSRFPPRWLDWGDISDVNPDYVAPNHPAIPELNFAIDVSRARNVACYFSHSCSPNVFVQFVLFDHYNASYPHLMIFAMENIPPLRELSIDYGMVDEWVGQLTM

SEQ ID NO: 21 - protein, 684 aa, Oryza sativa
MEMDTSPSSSAPSSPAASSDSIDLNFLPFLKREPKSEPASPERGPLPLPAAAPPPPPPPPPPPPPPQVQAATVATPVPATPDLSAAAVMTPLQSLPPNPEEETLLAEYYRLATLYLSSAGAAGVIVPAAAPEASAGAVAQPGSGSGAKKRRPRSSELVRVSSLSVQDQIYFRDLVRRARITFESLRGILLRDDERAEVLGLTGVPGFGAVDRRRVRADLRAAALMGDRDLWLNRDRRIVGPIPGISVGDAFFFRMELCVLGLHGQVQAGIDFVTAGQSSSGEPIATSIIVSGGYEDDDDRGDVLVYTGHGGRDPNLHKHCVDQKLEGGNLALERSMAYGIEIRVIRAVKSKRSPVGKVYFYDGLYKVVDYWLDRGKSGFGVYKYKMLRIEGQESMGSVNFRLAEQLKVNALTFRPTGYLSFDISMGREIMPVALYNDVDDDRDPLLFEYLARPIFPSSAVQGKFAEGGGGCECTENCSIGCYCAQRNGGEFAYDKLGALLRGKPLVYECGPYCRCPPSCPNRVSQKGLRNRLEVFRSRETGWGVRSLDLIKAGTFICEFSGIVLTHQQSEIMAANGDCLVRPSRFPPRWLDWGDVSDVYPEYVAPNNPAVPDLKFSIDVSRARNVACYFSHSCSPNVFVQFVLFDHYNAAYPHLMIFAMENIPPLRELSIDYGMIDEWVGKLTM

SEQ ID NO: 22 - protein, 678 aa, Brachypodium distachyon
MEVEESSPSSPLSSPSSSPSSDSIDLNFLPFLKREPKSEPASPEHDPLPPPPPPPPPPQAAAAVAVAYVDPTPATPDLSSPAVMTPLQSLPPNPDEDALFAEYCRLASLYLLSAGAGAIVQAPTPEAAAPAVVQPGSGSAVKKRRPRSSELVRVSSLGMRDQIYFRDVVRRARITFESLRGLLLKDDERAEALGLPGVVGLGSTDRRRVRADLRAAALMADRDLWLNRDRRIVGPIPGISVGDAFFFRMELCVLGIHGQVQAGIDYLTAGRSASGEPIATSIIVSGGYEDDDDRGDILVYTGHGGRDPNLHKHCVDQKLEGGNLALERSMAYGIEIRVIRAVKSKRSPVGKVYFYDGLYKVVDFWLDRGKAGFGVYKYKMIRIDGQDAMGSVNYRVAERLKVDALSMRPTGYLSFDISMGRESMPVALYNDVDDDKDPLLYEYLARPIFPSSAVQGKFAEGGGGCECIENCSIGCYCAQRNGGEFAYDKAGVLLRGKPLVYECGPYCRCPPSCPNRVSQKGLKNRLEVFRSRETGWGVRSLDLIKAGAFICEFSGIVLTHQQSEIVAVNGDCLVHPNRFPPRWLDWGDISDVYPGYVPPNHPAIADLNFSIDVSRARNVACYFSHSCSPNVFIQFVLFDHYNMSYPHLMIFALENIPPLRELSIDYGMIDEWVGKLTM

SEQ ID NO: 23 - protein, 519 aa, Populus trichocarpa
RSSELVRVTDLGIEDQRYFRDLVRRTRMVYDSLRILSILEEEKRRGERLGRRARGDLRAASAMRDCGLWLNRDKRIVGSIPGVQIGDVFFFRMELCVMGLHGQAQAGIDYLPASQSSNREPIATSIIVSGGYEDDEDAGDVIIYTGHGGQDKLNRQCEHQKLEGGNLALERSMRHGIEVRVIRGIKHEGSVSSKVYVYDGLYKILDYWFDVGKSGFGVYKYRLLRIDGQPEMGSSILKFAESLRTKPLTVRPRGYLSLDISNKKENMPVFLFNDIDNDHDPLCYQYLERTVFPVFVFTNGSNGTGCDCVSGCSDGCFCAKKNGGELAYDENGFLLKGKPVVFECGVSCRCPPTCRNRVTQRGLRNRLEVFRSRETGWGVRSLDVIHAGAFICEYAGVVLTREQAQIFTMNGGGLVYPNRFSAKWAEWGDLSQIYPNYTRPSYPELPPLDFAMDVSKMRNVACYMSHSSAPNVLVQFVLYDHNNLMFPHIMLFAMENIPPLRELSLDYGVADGWTGKLAI

SEQ ID NO: 24 - protein, 672 aa, Vitis vinifera
MGSLIPFQDLNLLPDPATSPSTAATAITPALIFPKIEPKLEPFDAPTLPLQSFPQNPSPNFFVNSGQLPFVGPGSNPNDTVFSQTPEGSPEENNVYSEYYRISELFRTAFSKRMENLGNIEVLDPDSRAIVPVPEETRISNVVVSRRRDQRSSELVRVTDLTIDHVRYFRDLVRRTRMLYDALRIFSMMEEEKRREVGLITRRSRGDLRAAKLMKDRGLWLNRDKRIVGSIPGINIGDLFLFRMELCVVGLHGQAQAGIDYLPGSRSSNGEPIATSIIVSGGYEDDQDEGDVLIYTGHGGQDKFSRQCDHQKLEGGNLALERSMHYGIEVRVIRGIKYEGSVTGKVYVYDGLYKIHDSWFDVGKSGFGVYKYKLLRNEGQAEMGSAILRFAENLRVSPLTVRPVGYLCDDLSTKKENIPVFLFNDIDGDNEPMYYEYLPRTVFPLHAYNLGGNGSGCDCVAGCTDDCVCAQRNGGEFAYDQNGFLLRGKPVIFECGSFCRCPPTCRNRLTQKGLRNRFEVFRSRETGWGVRSLDLIQAGAFICEYAGVVLTREQAALFSMNGDTLIYPNRFTDRWAEWGDFSKVYSDYVRPMHPSIPPLDFAMDVSRMRNLACYMSHSSCPNVLVQFVLYDHHNLLFPRLMLFAMENIPPLRELSLDYGVADEWTGKLPICN

SEQ ID NO: 25 - protein, 695 aa, Cucumis sativus
MDSPIPFQDLNLLPDPSSTAVMTAATSPKTATGINSSFNKFVDTGKLLTPKLEPKLEPFDDLFETRESQQPQSVQQPFLSTPSSNFFSNTDFSQTPFSDQNHTPLSQSSSISSDKDNVYSEFYRISQLFRSAFGKGLQSYGDADVEVVDPDAQAIVPVPEENQISTVVVSKRRYDKRSSELVRVTDLGVEDQRYFRDVVRRTRMIFDSLRVLSTAEEEKSPGLMRRLRGDLRASSLMRERGLWLNRDKRIVGSIPGVHIGDLFFFRMELCVVGLHGQAQAGIDYVPASQSSNGEPIATSIIVSGGYEDDEDAGDMIIYTGHGGQDKFSKQCMHQKLEGGNLALERSMHYGIEVRVIRGMKYAGSVASKIYVYDGLYRILDCWFDVGKSGFGVYKYKLLRIDGQAEMGSSILKFAENLRTKPLSLRPSGYLSLDISMKKEAVPVLLFNDIDNDQEPLYYEYLVRTVFPPFAFHQSGSGTGCSCVTSCVHDCFCAMKNGGEFGYDQNGFLVRGKPIIFECGPFCQCPPQCRNRVSQKGLKHRLEVFRSRETGWGVRSLDLIHAGAFICEYAGVVLTREQAQVFSMNGDTLIYPNRFSDRWAEWGDLSQIYSNYVRPSYPSVPPLDFAMDVSRMRNVACYISHSTSPNVLVQFVLYDHNNLMFPHLMLFAMENIPPLRELSIDYGVADDWSGKLAICN

SEQ ID NO: 26 - protein, 654 aa, Arabidopsis lyrata
MSTVVPFPDLNLMPASQSSTAGTTAGDTVVTGKLEVKAEPVEECQTPPSSFSDQSASTDLIAEFIRISKLFRSAFKPHQIEGLDGVSVYGLDSGAIVTVPEEENRELIKPPPGFGDNRVSTVVVSPPPTKFERPRELARIAILGHDQRKELRQVMKRTRMTYESLRIHLMAESMKNPVLGQGRRRRSDMAAAYIMRDRGLWLNYDKHIVGPISGVEIGDIFFYRMELCVVGLHGQTQAGIDCLTAERSATGEPIATSIVVSGGYEDDEDTGDVLVYTGHGGQDKQHKQCDNQRLVGGNLGMERSMHYGIEVRVIRGIKYENSISSKVYVYDGLYKIVDCWFAVGKSGFGVFKFRLVRMDGQPMMGSAVMRFAQTLRSKPLMVRPTGYVSFDLSNKKENVPVFLYNDVDGDQEPRHYEYIAKSVFPPGIFGQGGISRTGCDCKLSCTDDCLCARKNGGEFAYDDNGHLLRGKDVVFECGELCTCGPNCKSRVTQKGLRNRLEVFRSKETGWGVRTLDLIEAGAFICEYAGVVVTRHQAEILSMNGDVMVYPGRFTDKWRNWGDLSQVYPDSVRPDYPSLPPLDFAMDVSRMRNVACYISHSKDPNVMVQFVLYDHNHLMFPRVMLFALENISPLAELSLDYGLADEVNGKLAICN

SEQ ID NO: 27 - protein, 650 aa, Arabidopsis thaliana
MGSSHIPLDPSLNPSPSLIPKLEPVTESTQNLAFQLPNTNPQALISSAVSDFNEATDFSSDYNTVAESARSAFAQRLQRHDDVAVLDSLTGAIVPVEENPEPEPNPYSTSDSSPSVATQRPRPQPRSSELVRITDVGPESERQFREHVRKTRMIYDSLRMFLMMEEAKRNGVGGRRARADGKAGKAGSMMRDCMLWMNRDKRIVGSIPGVQVGDIFFFRFELCVMGLHGHPQSGIDFLTGSLSSNGEPIATSVIVSGGYEDDDDQGDVIMYTGQGGQDRLGRQAEHQRLEGGNLAMERSMYYGIEVRVIRGLKYENEVSSRVYVYDGLFRIVDSWFDVGKSGFGVFKYRLERIEGQAEMGSSVLKFARTLKTNPLSVRPRGYINFDISNGKENVPVYLFNDIDSDQEPLYYEYLAQTSFPPGLFVQQSGNASGCDCVNGCGSGCLCEAKNSGEIAYDYNGTLIRQKPLIHECGSACQCPPSCRNRVTQKGLRNRLEVFRSLETGWGVRSLDVLHAGAFICEYAGVALTREQANILTMNGDTLVYPARFSSARWEDWGDLSQVLADFERPSYPDIPPVDFAMDVSKMRNVACYISHSTDPNVIVQFVLHDHNSLMFPRVMLFAAENIPPMTELSLDYGVVDDWNAKLAICN

SEQ ID NO: 28 - protein, 364 aa, Ricinus communis; identical to SEQ ID NO: 15

SEQ ID NO: 29 - protein, 709 aa, Glycine max; identical to SEQ ID NO: 16

SEQ ID NO: 30 - protein, 682 aa, Zea mays; identical to SEQ ID NO: 17

SEQ ID NO: 31 - protein, 570 aa, Medicago truncatula; identical to SEQ ID NO: 18

SEQ ID NO: 32 - protein, 533 aa, Physcomitrella patens; identical to SEQ ID NO: 19

SEQ ID NO: 33 - protein, 710 aa, Sorghum bicolor; identical to SEQ ID NO: 20

SEQ ID NO: 34 - protein, 684 aa, Oryza sativa; identical to SEQ ID NO: 21

SEQ ID NO: 35 - protein, 678 aa, Brachypodium distachyon; identical to SEQ ID NO: 22

SEQ ID NO: 36 - protein, 519 aa, Populus trichocarpa; identical to SEQ ID NO: 23

SEQ ID NO: 37 - protein, 672 aa, Vitis vinifera; identical to SEQ ID NO: 24

SEQ ID NO: 38 - protein, 695 aa, Cucumis sativus; identical to SEQ ID NO: 25

SEQ ID NO: 39 - protein, 654 aa, Arabidopsis lyrata; identical to SEQ ID NO: 26

SEQ ID NO: 40 - protein, 349 aa, Arabidopsis thaliana
MGRPPSNGGPAFRFILPEVTEMEAILLQHNTAMPGRHILEALADKFSESPERKGKVVVQFKQIWNWFQNRRYALRARGNKAPGKLNVSSMPRMDLPNQMRSVIQPLSVPKTTHMTGNLPGMTPAPSGSLVPGVMRSGSDNSYLEFEAKSARDGAWYDVQAFLAHRNLEIGDPEVQVRFAGFEVEEDEWINVKKHVRQRSLPCEASECVAVLAGDLVLCFQEGKDQALYFDAIVLDAQRRRHDVRGCRCRFLVRYSHDQSEQEIVPLRKICRRPETDYRLQQLHNAVNDLANSNQHQIPALDAAAKTPLSLPGATVPIVAPESKDPSLSATPATLVQPSSNAATVPAGSA

SEQ ID NO: 41 - protein, 420 aa, Arabidopsis thaliana
MYPTGQQISFQTTPLNVQDPTRMMNLDQSSPVARNETQNGGGIAHAEFAMFNSKRLESDLEAMGNKIKQHEDNLKFLKSQKNKMDEAIVDLQVHMSKLNSSPTPRSENSDNSLQGEDINAQILRHENSAAGVLSLVETLHGAQASQLMLTKGVVGVVAKLGKVNDENLSQILSNYLGTRSMLAVVCRNYESVTALEAYDNHGNIDINAGLHCLGSSIGREIGDSFDAICLENLRPYVGQHIADDLQRRLDLLKPKLPNGECPPGFLGFAVNMIQIDPAYLLCVTSYGYGLRETLFYNLFSRLQVYKTRADMISALPCISDGAVSLDGGIIRKTGIFNLGNRDEVNVRFAKPTASRTMDNYSEAEKKMKELKWKKEKTLEDIKREQVLREHAVFNFGKKKEEFVRCLAQSSCTNQPMNTPR

SEQ ID NO: 42 - protein, 163 aa, Solanum lycopersicum
MKDVIGIVALLGKVDDDNLSRKGPMNKSSGLHGVGASIGRPLDDRYLVIFLENLRPYAGEFIVDDPQRRLAIRRKPRYVNEETPHVFLGFAVNMINIDTANLYCVTRTGYGLRETLLYGLFSQLQVYKTSADMMEALPFIIDGAISLDGGIIKSGGIFSLGKR

SEQ ID NO: 43 - protein, 1790 aa, Solanum tuberosum
MSSKRQCDDFSAETPRKKPSRVLRIQVDSDEEVGTNEGRVFYFRVLLPNGITLELQVPGPPSEMPVEDFVILVRREYQNLGRRTESPKPKRQINWTSKDLHFVDAFENRITKMLDFRKFKSNKSHMIRLCDGSAEADKYENMWDLTPDTDLLKELPEEYTFETALADLIDNSLQAVWPKSTDQRRLISLELTKSRITIFDTGLGMDGSAENSIVKWGKMGASLHRLSRDRGIGGKPPYLTPYFGMFGYGGPIASMHLGRRASVSSKTKECKKVFVLHLERDSLLRCSSSQQTWRTDGNVRDPLEDELRYSVDGSFTKVEIFYPKMRSESVQKLQYKLKDIYFPYIQCDEVSKTGKTVMPIEFQVNGTNLAEIEGGEVATTNLLSCNGPEFVMQLSFHVKDSNSLKIGSGTKSSFEGHARLRCVYFPMVQGKESIEVILEKLEADGYGITENFETFSHVSVRRLGRLLPDARWSWLPFMEPKLRKSDRAEVLKRCCFRVKCFIETDAGFNPTPSKTDLAHHHPCTIALRNFGNKPSDKENDVLIEISKDGKKLSLLQLEKLYQDWLLQMHDRYDEEIDCGEDQPTFVIGPSHKKELGVSADVLRIHKAFQRKGITWKAGQKIKILKGACRGFHKNNIFATLEFIILEGWQGDSGGEARIICRPLHVPAESGCRLTFDEGCACFEIRDSKSFPISVIDAGKCLAVDNTEWENQILKHQEKTTPSSIDILDAEQCQELDIKGALPQDVDAGHEPPEEITAVVRPASFSSVTAYKNLDQKYIMKENFEMTLEIKFKADENEKERHIYSGQLNPSSLKGFHGLYIFPLKKKSPNLFQKAGIYLFRFSLIESRTISVKEVRVKALPEAASWELVSDGKSTHSVRVGSCFPEVFSVACCDRFCNRIPFKSQTEIEMKLCSGGRAISSECSYDQCITHDRYTMKFKNVTIESSELDMIRPSYKATLHINSKEDPFFVAIPCAVIPGPLQRILLRPVDFGKKLVPGMVLKELALETFDKYGNHMRKDEHIKLTLEGLHLLDKGDSFYKVDDHGCVNLSGTLKVTAGYGKLVSLSVLSGDKVVFKKEFQTDRRSLRVASKVPKVCAAGSHLEDVVFEVINSAGEVDEDIDSEVEDGHSHTLLIRQDSLREEDNVRYSFHHGRCIVRSIPLPDNEGLFCFVASHSRFHELQTSIEVHVEKAVIRTHELTQPRSPKKEILLHEDSNGKGPETVCHNTFDGRIMIFNDSCASMDLEDRLQTVTKLECVSRQKLGDDICRYGLCIRRCDANVESLNIKQSNIELEMSNLGVVWLYVVRKLFNWHMKSKSNVMCIMNHAYVKPTAWHGHMQKAVVTSSLNHDLEPCSFKPKDYYLRRLHLLYILLYLLAFRLRSVNVSERSEPKSRNIDCWHQVHVVISLFGWFKCSPDISFLFLMSLEFSLNFSLLSVPGAITSLAISQSVKLKEIINCNMKLVMDAAFIGLDSFHDLGYDKDVIMEKIEGKADSAAAVIHKLLRSPKPEQLYLKYAHDILGVVALLGEVRTHKLSSMFSTYLGEDQMLAVVCKSRAAARALENYRMDGNVNCASALDILAAKLGISIKGRYLVICLEDIRPYKQGVSSDPQRELAIPHPTLSNRETPPGFLGYAVNMIFLPAEYLQLRTASGHGLRETLFYRLFGKLQVYKSREQLYMASSCIEEGAVSLDGGMMRGNGVVSASVGSEEPYILFPVICLERQLLLSPEKVKRLKRIEELKLERNQLQDQIQEELRNEAKYKKKLAKKLRDKKQIDDQLEPSPGMYSSDMDISC

SEQ ID NO: 44 - protein, 350 aa, Phaseolus vulgaris
MSQLNHTQSLRDDISERSKIIKQHEDNLKFLNSQSNQLAESIFDLQVSLAKYHSNNVITSDSGNGAFHTEEETMEQIMKKENTAAGVFSWLKGNAQTSNLTLTKDVVGVVATLGKVESDNLSRILSEFLGLERMLAIVCSSYEGINALEKYDTEGLINCNAGLHGIGSSIGKRINGRFAVISLEDLRPFVGGLVADDPQKKLALPKPRLPNGECPPGFLDYAVNMIHLDSKHLSFLTDIGHGLRETLFYGLFSRLQIYKTRNEMLLALPCIYDGALSLDGGMIQRGGMFALGCRKDVEVKFPLISGGSDVPSNYIETEETVRKLNWETSKLSADKHREQQLLDYRKGNLH

SEQ ID NO: 45 - protein, 431 aa, Vitis vinifera
MFQPHNQLSIQTKPLAIQEPSALMHVDPNNSFGAARDEMHNGGLSKAESAVNNSKKLQDELQTLGFKIKQHEDNIKYLKTQKDNLDGSILDLQVTLGKYCSSSIPTMENEALSKSRSENETVEQILKYEKSAAAILCQLKIRHGSQASHLTLAKDVLGIVATLGKVDDENLSRLFSEYLGLETMMAIVCKTYEGVKTLETYDFEGGINKHSGLHGLGSSIGRHLDGRFRIICLEHLRPYAGDFVADDTQRRLDLLKPRLPNGECPPGFLGFAVNMINVDSANILCLTSSGCGLRETLFYNLFSRLQVYRTRAEMLLALPCITDGALSLDGGMIKTAGVFSLGSREDVEVRFPKSSGSNLPLEYFETEKELTEVNWKREKVEEDIQREQSLLNHINYTFRIKKQAFIKYLADSSPYGIQQQIPGERERLTQR

SEQ ID NO: 46 - protein, 1596 aa, Theobroma cacao
MQSQFNAMEDKFHRRASKRPLVLEDEDDADGSNEVYRFKVLLPNGTSVDLSLKNQKPEISFEDFIDLIRVEYDYIVRSQRQSVKRKRIINWNSEKLYLEGDMGGKIMSRIKLRHFKPLKCHILRLHDGSGEVANTYENMWDLTPDTDLLMELPEEYTFETALADLIDNSLQAVWLNGKNERRLISVNVLENTISIFDTGPGMDSSDENSIVKWGKMGASLNRLSKVQAIGCKPPYLMPFFGMFGYGGPIASMHLGSCAIVSSKTKESKKVYTLQIAREALLNNSNPERCWRTDGGIRDASEDEIEKSPHQSFTKVEILKPKQKNLDIFKLQCKLKDTYFPYIQCDELSKVGRTITPVEFQVVNGVDLTEIDGGEAAITNLLSCNGPEFSILLHFSLRRENVATKGSKASQEANARLKCIYFPIRQGKENIERILERLGAEGCGVRENYEDFSRVSIRRLGRLLPDARWALLPFMDLRQRKGDKSHLLKRCCLRVKCFVETDAGFNPTPSKTDLAHHNPFSIALKNFGSRHVEKEKDVDVDIYRGGKQLTFLQLEREYQDWLLLMHDSYDEEIVSGEDQPVLVVGPLNKKALGISSDVIRVHKILKRKGVLWKRRQRIKVLKGACAGFHKNNVYATLEYFLIEGFQGDFGGEARIICRPLGLSNGSILSVKDGNASFDIRSSLSLPVSVIDSGKCLAIDDTDWDCQLEKQCQKAPSRIDLLNAKQCQELEVDGALPADATVHAGLVPPKEIVAVLRPRSFGSSSASNDLEQKDILKINLEMSMEVNFRRTKNHQDVKHIYSGRITPSSHKGFNGLYVFPIGSKFTHLFQVAGLYTFLFSIEHSGCQDCKKTLLVVPSLKVGKWRLLSDGKIPSYNVRVGSCFALIPIACYDIYGNRMPFSSIPNFKIKLVMNEGMLVDVTQMKPSLSSDNLVLNIEDVMIESNGLDSMRPHYAATLVIYSKDESVSISVECQVTPGALRNVRACPEVLGNQLLPGFIIEQLVLEMFDAYGNHVAEGAEVQFHLDGFVIQGHLGSKYKVDDRGCIDLGGLLEVTAGYGKSVSLSVLHDGKVVFKREFQTEKRELRIASVVPERCIAGSILEDLAFEVVDSQGVVDETFHDDEKHGQSHRLIVNSESFETCDSICYAFIHGCCIVTSIPLPEIEGPFCFVAFHSRYMDLYLNVKVSLVRPRKVESDEIEYPSDQKGLFLQKSQSVKDVGCLLSLVKYDKELEDEVCKYGERIAKWEHLLETLDCRKASIERYVSGLQASLEPNLIDNLDSLSTKEEMMIRIKERDHSAASVLCSLAQKLPFQEPWMDVIEGLVGVVALLGTVCTSKLSRILAEYLGEDQMLAVVCKSYTAARALEKYEHNGKVDWKLGLHAEATALGKSISGRFLVVCLEDIRPYPGLIEVSDPQRKLALPDPRLPTGNTPPGFIGYAVNMVNIDHPHLENLTTAGHGLRETLFYRLFSKLQVYETREHMENARACIKHSAISLDGGILRKNGIISLGYRNPEIHFPVQMHVSQQHKEIMEQIKKMKLELRSILQHIERISENHAKASKKFNKRKMKLEKCMDRMDSTIKYYHVEYAPNTLKSEEAPPM

SEQ ID NO: 47 - protein, 1261 aa, Glycine max
MVLFEMQNMWDSTPDTDLLLELPEEYTFETALADLIDNSLQAVWSNGEDKRKLIRVNLGKSKISIFDNGPGLDDTDENSLVKWGKMDASLHRSSKSKAIGGKPPYLMPYFGMFGYGGPIASMHLGRRASVSYKTKHVKKVYTLHLEREALLNTSSSQLTWKTGGGIRDPLANEIRDSHGSFTKGESSVTEYFNVLYRHWQQLDIYEKVSRCGTKDKKKYKELGTDRIYKFLLGLNKDLDEVRGRILGFKPLPKIREVFSKQEETSLDHHKRKTTPGVIIVRGQATPRKHAGSSMQFKSKEGRGNTAFNHQQAEVNSNSSSFSKEQMEALQTLFQQSMILELGKTIGNAEECVGLYLFQVEKPKELKNHSYVAASVPSSDNSVMWHCRLGHPNFILNRYKVRFVAKGFTQSYGVDYEETFALVAKLNFVRCDDTSDRGKTITPIEFKVNDVDLTEIQGGEVAITNWHSCNGPEFVFQLHLKSESSRELQANARMRFVYLPFTKGKENIERVLEKLKSDGFVISEDFQSFSRVSVRRLGRLLPDARWTLLPFMDFRNKKGIKAQILKRCSQRVKCFIETDGGFKPTLSKTDLAHHNPFTAALKNFGNKFSEKEKDVTVEIRKATKVLTLLKLQMEYQDWILQMHHQYDEEADSGEDQPVIIVGPANEKALGISSDVIRVHQVLNRKEKSWKRGQKIKVLKGACAGCHRTTIYATIEYFLLEGFEGDAGGEARIICRAIDIPDENGSFLSVGDEDASLEIRGSLSLPISVIDSGKVIAVESIEWENRLTKKQQKSTSIYLPGANHYENLETNGVVSVESIEWENRLYKKQQKSPSINLSGANHYEHLEADGVPVIKMPIVKYAGQPPCTDKGIIDLQEPSLYHENSLIEFFLNYDKELFDSICKLAERIQKVESHLNNSNEKKAETEQEMVKLLEKVEPYQLSIMDSSFTKDELMTKIRSMENSPYSVLCSLSKREKPPNYFLEDLIGVVALIGTVQRPELSRILAEYLGEAKMLGLIYRSFDTASSLEKYNQKGEIDYERALHAEAAALGKAISNRFHVICFEDIRPYTGWLHDDSQRRLALPNPRIANGETPEGFIGYAVNMVDLDINSLQIMTASDFGLRETVLFNLFKKLQVYNTRENMVAARTCIEDGAVSLDGGILSENGILSLGYGNPSICFPCENQKVLPREIEKILPQMEGKKSDLRMIEERIKGLEHSRAKYIKKFNKKKERYDKVTDRMKPMTELLKYKPEAGDGSNSSGRLS

SEQ ID NO: 48 - protein, 418 aa, Oriza sativa
  Japonica group
MAVQSAERGVEAPPLTLSIFEFNSKVMQDELQKLALKVNHHEENIRFLKSELNAVEDSCADLGIKIGNYYSSMAAIANNDTSVEEAEQRTIQSILKQDETAAGIICQLKIRHYQHASKLPLMKDVLGVVATLGKINNDNLSRVLSEYLGLDNMLGVVCKTYDGVEGLETYDKEGMVDKTSGIHGLGRTIGKFLDGRFTVFCLENIRPFSGDFMIDDPQRKLLLHKPRLPSGEFPPGFLGFAVNMIHLDQANLSCLTAGGHGLRETLFYSLFSQLQVYKTRAELRNAIPLINDGAVSLDGSILRPNGSFCLGNRASLGIQFPVTANLGVSNLPVTITELEEQVKHKNWEKERLLEDIKRQEDLLNQVKDLFSKKKEQFMAYITQPGMLQRASQASPTIPSPATPGSNPFGSRPPHLRGR

SEQ ID NO: 49 - protein, 344 aa, Oriza sativa
  Indica group
MAAIANNDTSVEEAEQRTIQSILKQDETAAGIICQLKIRHYQHASKLPLMKDVLGVVATLGKINNDNLSRVLSEYLGLDNMLGVVCKTYDGVEGLETYDKEGMVDKTSGIHGLGRTIGKFLDGRFTVFCLENIRPFSGDFMIDDPQRKLLLHKPRLPSGEFPPGFLGFAVNMIHLDQANLSCLTAGGHGLRETLFYGLFSQLQVYKTRAELRNAIPLINDGAVSLDGSILRPNGSFCLGNRASLGIQFPVTANLGVSNLPVTITELEEQVKHKNWEKERLLEDIKRQEDLLNQVKDLFSKKKEQFMAYITQPGMLQRASQASPTIPSPATPGSNPFGSRPPHLR

SEQ ID NO: 50 - protein, 405 aa, Zea mays
MATPSLPTQIVEFNYKAIEDKLKRLALEVSHHENNIRFLKSQLNTVEEACVDLGIKLGNYHSSVAAVVNNDTSAQEAEQRTIRSILDQGKTAAGIICQLKVRHHELASKMPLMKDILGFVATLGKVNNDNLSRLLTEYLGMDNMLALVCKTYDGVKGLEKYDKDGIIDNTSGIHGLGRSVGKFLDGRFTVFCLENLRPFSGDVIIDDPQRKLILHRPRLPGGESPPGFLDFAVNMIHLDRAHLRFLTASGHGLRETLFYTLFSHLQVYKTRTDIQSALPLIKDGAVSLDGGLLRPNGSFCLGHSKNLEVKFPVTTDVSSLPENVAEMEEQVKRKNWEKEMVLEDMKREEDLLKQVKELYRKQKQELMDYVTQPAVTQMSRDSPATHSPATPGSNPFGAKLSNKWR

SEQ ID NO: 51 - protein, 388 aa, Sorghum bicolor
MEDKLKRLALKVGHHEDNIRFLKSQLNAVEDACIDLGIKLGNYHSSVAAVMNNDTSAQEAEQRTIRSILDQDTTAAGIICQLKVRHHELASKMTLMKGILGFVATLGKVNNDNLSRLLTEYLGMDNMLALVCKTYDGVKDLEKYDKDGIIDKTSGVHGLGRSVGKFLDGRFTVFCLENLRPFSGDINIGDPQRKLILHRPRLPGGESPPGFLDFAVNMIHLDRAHLSCLTASGHGLRETLFYTLFSHLQVYKTRADIQSALPLIKDGAVSLDGGILRPNGSFCLGDSKNLEVRFPVNIEVSSLPENIAEMEEQVKLKNWEKERVLEDMKREEDLLKQVKELYRKQKQELMDYLTHPAVAQTSRDSPTTHSPTTPGSNPFGAKPSHKGW

SEQ ID NO: 52 - protein, 658 aa, Artificial Sequence
  Synthetic Construct
MYPTGQQISFQTTPLNVQDPTRMMNLDQSSPVARNETQNGGGIAHAEFAMFNSKRLESDLEAMGNKIKQHEDNLKFLKSQKNKMDEAIVDLQVHMSKLNSSPTPRSENSDNSLQGEDINAQILRHENSAAGVLSLVETLHGAQASQLMLTKGVVGVVAKLGKVNDENLSQILSNYLGTRSMLAVVCRNYESVTALEAYDNHGNIDINAGLHCLGSSIGREIGDSFDAICLENLRPYVGQHIADDLQRRLDLLKPKLPNGECPPGFLGFAVNMIQIDPAYLLCVTSYGYGLRETLFYNLFSRLQVYKTRADMISALPCISDGAVSLDGGIIRKTGIFNLGNRDEVNVRFAKPTASRTMDNYSEAEKKMKELKWKKEKTLEDIKREQVLREHAVFNFGKKKEEFVRCLAQSSCTNQPMNTPRKGGRAKLGTDYKDDDDKDYKDDDDKDYKDDDDKGSLEVLFQGPLEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGLEGSMAGGLNDIFEAQKIEWHEDTGGS

SEQ ID NO: 53 - protein, 663 aa, Arabidopsis thaliana
MSHDRSVNVSHDAVIAKPERGTMLQSFSPRSHGSKGYSLPQDSEENRGSVGQSAGQSSTSVVDQVRSPADDAGVTSSSTICPAPVCRQFWKAGSYNDELSSKSQQPNGKNYLHVHPMFLHSNATSHKWAFGAVAELLDNAVDEIQNGATFVIVDKTTNPRDGATALLIQDDGGGMDPQAMRHCMGFGFSDKKSDSAIGRYGNGFKTSTMRLGADVIVFSRHSKNQTLTQSIGLLSYTYLTRTGHDRIVVPILDYEFNASAGEFKTLQDREHFISSLSILLEWSPFSTEAELLQQFDDVGPHGTKVIIYNMWLNSDAKLELDFDSVAEDILIEGSIKKTGSKIVNDHIASRFSYSLRVYLSILYLRIPETFKIILRGKVVEHHNVADDLMHPQYILYKPQAAGSEEALVVTTIGFLKEAPKVNLHGFCVYHKNRLIMPFWQVINYSSSRGRGVVGVLEANFVEPTHNKQDFEKTVLLQKLENRLKEMTVEYWSCHCVLIGYQVNKKPRLQIPQKVQPAGRQALSPPPGFQAVFPQGNTTSLPRVSTQPVLLEKRKEHPDSVASAALKRKVGNDDFTVPGHIRVEQFIHGSASQSQDIETVKLMEENKKLRAKCLDRKVRSQNLEVKAMNLRSELENYKSEYERLMVELQALDLVKDEHRRNVNT

SEQ ID NO: 54 - protein, 718 aa, Solanum lycopersicum
MSSTNMVGLCSNNLGGGEIETVKLEPILVESLIPQMECCEADSLPYKKSSSSCGRQDSTATEQSRTSVLDQDQSPIDDSSLCSTSQICPAPLSRQFWKAGNYDEGHATKSTLKKGSSFLHIHPKFLHSNATSHKWAFGALAELLDNAVDEIQNGASFVIVDKTPNPRNGSSALMVQDDGGGMDPEAIRRCMSFGFSDKKSASTIGQYGNGFKTSSMRLGADVIVFSRCKKNRKLTQSIGLLSQTFLTRAGLDKIVVPLLDFEFSAAAKKWSSLHGEQHFRNNLSLLLRWSPFATEAELLKQFDDIGDHGTKVIVYNLWYNDEGRMELDFEADSEDIRLSGEANDNEKNASRIKVTDQHLANRLRYSLRAYLSVLYLRIPDNFCILLRGRVVELHNIAKDLKYPEFIMYKPQTLGFKEGSVITTIGFLKEAPVVNIHGFNVYHKNRLILPFWHVVRYSDSRGRGVVGVLEANFIQPTHNKQDFEKTPLFQKLEVRLKEMTWEYWDYHCGLLGYFPKKRPQGPITPQASSESRQQHGSYKPIVLGNSSGAVGSNITVRRTVTSEASSESRQQHGSYKPAVLGNSSGAVGSNITVWGTVTPVFQNNSKQGASKRKAVDHPIEHENLKRTAGLIVDLTGGERSQEILTLTSSGSQDQEAAHLIQENEKLRAQCCECEKREEELHSKVNKLRKELKEAQRTYAHMLVESRLLDKVKPEEDVYI

SEQ ID NO: 55 - protein, 830 aa, Solanum tuberosum
MWMQEDDLVVVEKDPGMSSTNMVGLCSNNLGGGETETVKLEPELVGSSLPQMEYCEADSLPYQKSSSSGGRQDSTATEQSGTTVLDQDQSPIDDSSLCSTSQICSAPLSRQFWRAGNYDEGRATKSTLKKGSSFLHIHPKFLHSNATSHKWAFGALAELLDNAVDEIQNGASFVIVDKTPNPRNGSSALMVQDDGGGMDPEAIRRCMSFGFSDKKSASTIGQYGNGFKTSSMRLGADVIVFSRCKKNRKLTQSIGLLSQTFLTRAGLDRIVVPLLDFEFSAAAGKWSSLHGEQHFRNNLSLLLRWSPFVTEAELLKQFDDIGDHGTKVIVYNLWYNDEGRMELDFEADSEDIRLSGDANDNEKSGSRIKVSDQHLANRLRYSLRAYLSVLYLRIPDNFCILLRGRVVELHNIAKDLKYPEFIMYKPQTLGFKEGSVITTIGFLKEAPVVNIHGFNVYHKNRLILPFWHVVRYSDSRGRGVVGVLEANFIQPTHNKQDFEKTPLFQKLEVRLKEMTWEYWDYHCGLLGYFPKKKPQGPITPQTSSESRQLHGSYKPVVLGNSSGAVGSNITVRGTVTSQVSSESRQQHGSYKPVVLGNSSGAVGSNITVRGTVTSQASSESRLQQGSYKPVVLGNSSGAVGSNITVRGTVTSQASSESRLQQGSYKPGCPGKLLWLHLNLDYNKGHINLVVLGNSSGAVGSNITVRGTVTPVFQNNSKQGASKRKAVDRPIEHENSKRTAGLVVDLTGGERSQEILTLTSSGSQDQEAAHLIQENEKLRAQCSECEKREEELHSKVNKLRKELKEAQRTYAHMLVESRLLDKVKPEEDVYI

SEQ ID NO: 56 - protein, 670 aa, Phaseolus vulgaris
MGPTEIVDLSSDDESETVCLKAVKLEGDFVMDKKCQSHTTGQDSEENLSSNGPSTGHSNSSVLEQGPSPVDDTCISYVSPIGAAPLCRQFWKAGNYDDGIGSKVTVQNAKNYLHVHPMFLHSNATSHKWAFGAIAELLDNAVDEIQNGATFVIVDKTSNPRDGSPALLIQDDGGGMDPEAMRRCMSFGFSDKKSQFAIGRYGNGFKTSTMRLGADVIVFSCHLNNRILTQSIGLLSYTYLTQTQLDRIVVPMVNYEFNTSTGSLEVLNGNDHFVSNLSLLLRWSPYSSEADLLKQFDEIGSHGTKVIIYNLWCNDDGNLELDFDTNSKDIRIAGDVKRIDTLKAWKSVNEDHIANRFRYSLHVYLSILYLKIPERFQIILRGQVVKPHNIADDLKYPQFVKYAPLIGGSTKGTALTVTTIGFLKEAPQVNIHGFNVYHKNRLILPFWQVVNYLDSRGRGVVGILQADFIEPTHNKQDFERTSLFQKLEVRLKEMTWEYWDTHCTLFGYKKEKRKFTPGVTSMQNPLTIEKPVILNKSSSSLVNAKAYGNSLQCSKNLQSLDQGSQSKRKKTHELVDLMNTQEHASTDNVACVGFSQNKQTMATPADQVGDQKNLHLIHQNKQLHAKCLEFEKTGEELNLKVVKLKSKIQEAQDEYKRLLAEIKSLDVKEE

SEQ ID NO: 57 - protein, 709 aa, Vitis vinifera
MSFPDIVDLCSDDEHVEVDVKPVKLEPNIIEREIQLFKCHEILQAQYQLSKTHCRTQESEENRDSNALSTAQSSTSILDQGQSPMDDTSLSSTSPICPAPLCRQFWKAGNYDDELGSKVTLQNGKNYLHVHPMFLHSNATSHKWAFGAIAELLDNAVDEIQNGATFVIVDKTSNPRDGSPALLIQDDGGGMGPEAMRCCMSFGFSDKKSKSAIGQYGNGFKTSSMRLGADVIVFSRHLDNGKLTQSAGLLSYSFLRQTGHDRIVVPMVDYEFNTSTSNMEPLHRYGKKHFTSNLSILLRWSPYSTEQELLKQFDDIGYHGTKVVIYNLWFSDDGNVELDFDSDPEDIRIGGDIKQVTTIPAWKTINEQHIANRFHISLRVYLSILYLRIPQNFNIILRGKVVEHHNIANDLKFPEFILYRPQTGGLVEGTVVTTIGFLKEAPQVNIHGFNVYHKNRLILPFWQVVNYSDSRGRGVVGVLEANFIEPIHNKQDFERTSLFQKLEGRLKEMTWEYWDYHCGLIGYQVKKKPRTLVSPHISSHGSPHIAMEKPIGLNQSSPAIGNIKATPPGGAFQHPAATASHCLAGRPGEPITDSQSRSQQGASLKRTEHDHPVEPEKKKHAGIKEIVTDTHSQETQPVDIFANHSKDQEAMTLMQENKKLHAQCLEYEKREKELSVKMIQLRNELREVHNEQARLLAELQHLDAIKDEK

SEQ ID NO: 58 - protein, 692 aa, Theobroma cacao
MNCVEIVDLSSDDELGEVDVKPVKLEPGTVVGSTTKQKNNHRFQPVELVKYKTQSGKQASEENKSSNNALSTGQSSTSFLEQGQSPGDDTGVSSTSAVSPAPVCRQFWKAGSYEGGLGSKVTLQNSKNYLHVHPLFLHSNATSHKWAFGAIAELLDNAIDEIQNGATFVIVDKTSNPRDGSPALLIQDDGGGMDPEAMRRCMSFGFSDKKSKSAIGQYGNGFKTSSMRLGGDVIVFSRHLDNRSLTQSIGLLSYTFLTRTGHDRIVVPMVDYELNVSTGMLDVLHGREHFVSNLSILLQWSPYSTEAELLKQFDDIGSHGTKIIIYNLWLNNDRDSELDFDSDPKDIRISGDTKKVNTIPAWKAVNEQHIASRYHISLRVYLSILYLRIPDTFRIILRGEIVEHHNIADDLKFIEYILYRPQSFGSVEGTVVCTIGFLKEAPQVNIHGFCVYHKNRLILPFWQVVSYSDSRGRGVVGVLEANFVEPTHNKQDFERTSLFQKLEGRLKEMTWEYWDYHCGLIGYQVKKKSRPAASHVSSHFTGQSSAEQPVLLNQTSLDADRAKTGCTDVGVKQSITNSHGRSMQGLPTKRKEPGDLANLEKVKRQAGTSANTVVQPVDTTANHSKDQETIYLMQENKKLRAKCSEYEKRREELNIKVEKLRSEVGEVQREYYRLLAELNSLDIVKDENDVYM

SEQ ID NO: 59 - protein, 664 aa, Triticum urarte
MRSGGAAEVIDLSSDDDGESLPFPSTSAVTVAPSSTRDAKPYELADVKPLLYPIQHPGCYALVPVKDEDPVPLPLAAKAPRVLPPPRLCRQFWKSGEYVVARRNPDADAPGGRNRLRINPKFLHSNATSHKWAFGVLTSLIFAAIAELLDNAIDEVNNGATFVRVNKFTNPRDGSPSLLVQDDGGGMDPDALRCCMSFGFSDKQSDAFIGQYGNGFKTSTMRLGADVIVFTQNQKNWTPTRSIGLLSYTFLMETGCDDVLVPTVDYQYDLTTASYTQLLRHNQKLFSSNLAILSKWSPFASEAELLKQFDDIGEHGTKIIVFNLWFNDDGDMELDFNSDKKAYASILYLRVPDSFRIILRGQDVEPHNVVNDLLYRECVLYKPQIAGLPELSIVTTIGFVKGAPDTDVQGFNVYHKNRLITPFWKVASNSYGKGRGVVGILDASFIKPTHDKQDFEKSVLHQRLENRLKEMTYEYWGLHCHRLGYDNKSLPKASRALYRAKQTGAGSSPASVPHQLLTADIPTSSCVQSSMGQKRNFDALGVISDINNHQTKARETSSMGIYLFCLHRDVIQRKRFHEYKTLTLENDKLRDECLQYEESEKQLVEKKSTILVKFSHIIFNLLIEIMVYFTIVKEQKLRYQIAKETKKYEELLEELKLLDVKLET

SEQ ID NO: 60 - protein, 688 aa, Glycine max
MGPTEVVYLSSDDESEKEVAFKAVKLEEDFVLDAKQYNETNKGQLAKHKRSQSHTTGQDSEENLSSNGPSTGHSNSSVLEQGPSPVDDTGISYASSIGVAPLCRQFWKAGNYDDGLGSKVTVQNAKNYLHVHPMFLHSNATSHKWAFGAIAELLDNAVDEIQNGATFVIVDKTSNPRDGNPALLIQDDGGGMDPDAMRRCMSFGFSDKKSQFAIGRYGNGFKTSSMRLGADVIVFSCHLNNRILTQSIGLLSYTYLIKTQLDRIVVPMVNYEFDTSTGSLKILNGNEHFVSNLSLLLRWSPYSSEADLLKQFDDIGSHGTKVIIYNLWCNDDANLELDFDTDPTDIRIAGDVKQIDTLKAWKSVNEEHIANRLRYSLHVYMSILYLKIPESFQMILRGQVVKPHNIADDLKFPQFVKYAPVIGGSVKGTALTVTTIGFLKEAPQVNIHGFNVYHKNRLILPFWQVVSYLDSRGRGVVGILQADFIEPTHNKQDFERTSLFQKLEGRLKEMTWEYWDTHCTLFGYKDKDKKKLPPRVTSMQKPLAIEKPVMLNRSCSPVVNTKIEYGNSEQCSTKLQIRSEQGSHNKRKTHELVDLQNTEKHARTENVTCVGFSQNKQIIATPADQVFDRKTMHLVQQNKKLHAKCLEFEKTGEELNLKVTMLKSEIQEAQDEYKRLLAEVKSLDLKEE

SEQ ID NO: 61 - protein, 682 aa, Oriza sativa
  Japonica group
MRSTAAAADVIDLSSDDDDEVPVPSTSAAAAAAARRVAPSTSPRDVTPYALVDVKPALLYPLQPPGVVVGGSGALVPVKEELPVLTPVPLLAAGYSPSTPSTKVALPAPRLCRQFWKSGDYVVAQRNPDADAPGGRNRLRINPRFLHSNATSHKWAFGAIAELLDNAIDEVNTGATFVRVNEFTNPRDGSSSLLIQDDGGGMDPEALRRCMSFGFSDKQSDALIGQYGNGFKTSTMRLGADVIVFTQNQNNWVPTRSIGLLSYTFLMETGCDDVLVPTVDYQYDISTASYTQMLRHDQKLFSSNLAILLKWSPFASEAELLKQFDDIGEHGTKIIVFNLWFNDDGDMELDFNSDKKDILITGAHRKVNTNKADKVATQNYVSTRLRYSLRAYTSVLYLHIPDNFRIVLRGHDVESHNVINDLMYPECVLYKPQIAGLAELSAITTIGFVKGAPEIDVQGFNVYHKNRLIAPFWKVANNSYGKGRGVVGILEANFIKPTHDKQDFEKSVLYQRLESRLKEMTYEYWDLHCHRIGYDNKKLPKSSRALNRANQMNAGSSPPIVPRQLLAADIPTSSCAVPTFMAPALRQKQMGLKRNIDALGSKTDSADQDGSHLDVSQRRRFNEYRTLTLENDKLRGECLQYEESAKQLALKEQKLRSQIALERKKYEELLQELRSLDVKTEK

SEQ ID NO: 62 - protein, 648 aa, Oriza sativa
  Indica group
MRSTAAAADVIDLSSDDDDEVPVPSTSAAAAAAARRVAPSTSPRDVTPYALVDVKPALLYPLQPPGVVVGGSGALVPVKEELPLLTPVPLLAAGYSPSTPSTKVALPAPRLCRQFWKSGDYVVAQRNPDADAPGGRNRLRINPRFLHSNATSHKWAFGAIAELLDNAIDEVNTGATFVRVNEFTNPRDGSSSLLIQDDGGGMDPEALRRCMSFGFSDKQSDALIGQYGNGFKTSTMRLGADVIVFTQNQNNWVPTRSIGLLSYTFLMETGCDDVLVPTVDYQYDISTASYTQMLRHDQKLFSSNLAILLKWSPFASEAELLKQFDDIGEHGTKIIVFNLWFNDDGDMELDFNSDKKAYTSVLYLHIPDNFRIVLRGHDVESHNVINDLMYPECVLYKPQIAGLAELSAITTIGFVKGAPEIDVQGFNVYHKNRLIAPFWKVANNSYGKGRGVVGILEANFIKPTHDKQDFEKSVLYQRLESRLKEMTYEYWDLHCHRIGYDNKKLPKSSRALNRANQMNAGSSPPIVPRQLLAADIPTSSCAVPTFMAPALRQKQMGLKRNIDALGSKTDSADQDGSHLDVSQRRRFNEYRTLTLENDKLRGECLQYEESAKQLALKEQKLRSQIALERKKYEELLQELRSLDVKTEK

SEQ ID NO: 63 - protein, 750 aa, Zea mays
MCMSSLIAPTRPRRLSFENSKRLEEASTDYMDAERDIKPFVFPTVPTTIQRNFHGPGARQPTARPLERCGTRVLPQTHRPCSAPRLSRKFWGAGDYDAVAGRSAPQPPSLQNRMCVHPEFLHSNATSHKWPFGVCLTFFPIAIAVAELLDNAVDEIETGGATTILLDKLIDKRNGSPALLIQDDGGGMDPDSLRRCMSFGFSEKQSGSSIGQYGNGFKTSTMRLGADAIVFSRCCTRSSGPTQSIGLLSYTFLVETGHTNVVVPMRLERHGSKQFFSNLSALLKWSPFATEEELMQNFCDIGPHGTKIIVFNLWSNDDGNLELDFDTNPEDIMISGAPNPEQISNSVRRANENHLANRLRYSLRVYASVLYLQLPDYFRIMLRGREVERHHIASDLIYPERISYRPQSCGIIREAEVLTTIGFLKGAPTISVHGFNIYHKNRLILPFHRVLSTASSKGRSVSGVLEVDFIKPTHDKQDFEKSQLFQRLMNRLKEMTNEYCTDAYFASNVTTQMSRSFHRDLYSNKIGYVKVPRVRAAPTPAPPVMLAIENGPAEPSERSAPAPTQPLRWQHGNSSCVNAVPIAMAPPAFHPAPVKTETDAPGAPTGYAYSYSPSWPSVQAMQIEKIKEEPSMAAPGTDWVETRKRTNDDGATTVALFKRRKAPQELAGSGSRSATDQVSRYVGEGELNEFCFLKMENRMLRGECSEFEMAEKELRVKEQNLRLEIEMAQEQFKRLLGEYVSFSSMPTRKP

SEQ ID NO: 64 - protein, 676 aa, Sorghum bicolor
MSLGAEVIELSSDEEEEPVPSTTALARHAPSSPPDVKPHLFADVDVKPLLLPPPLHPPGYGALVPVKTEEPVPVPVATVSPPPRALPPPRLCRQFWKSGDYVVARRNPDADVPGGRNRLRINPKFLHSNATSHKWAFGAIAELLDNAIDEVNNGATFVRVNKFKNPRDGNPSLLVQDDGGGMDPEALRRCMSFGFSDKQSDAFIGQYGNGFKTSTMRLGADVIVFTQNQNNWVPTRSIGLLSYTFLMETGCDDVLVPTVDYQYDPTTTSYVQMLRHDQKLFSSNLAILLKWSPFASEAELLKQFDDMGDHGTKIIVFNLWFNDDGDMELDFNSDKKDILITGAHKMVKTNNPEKIAAQKYVSTRLRFSLRAYASILYLHVPDTFRIILRGRDVEPHNIVNDLMYRECVLYKPQLAGLTESSVITTIGFVKGAPDIDVQGFNVYHKNRLISPFWKVANNSYGKGRGVVGILEANFIKPTHDKQDFEKSVLYQRLEIRLKEMTYEYWDLHCHRVGYDNKKLPKAIRAVNRANHMNGGSSPISAPPRLLAADIPTSSCGIPRLSASAAREKINSLDSLSKSPMGLKRKFNSFSAMAGSADQDGLDHMDKVDVSQRKRFNEYKTLTLENDKLRNECLQYEESEKQLVLKEQKLRSEIAEAEKKYQELLVELRSLDVKKEK

SEQ ID NO: 65 - protein, 914 aa, Artificial Sequence
  Synthetic Construct
MSHDRSVNVSHDAVIAKPERGTMLQSFSPRSHGSKGYSLPQDSEENRGSVGQSAGQSSTSVVDQVRSPADDAGVTSSSTICPAPVCRQFWKAGSYNDELSSKSQQPNGKNYLHVHPMFLHSNATSHKWAFGAVAELLDNAVDEIQNGATFVIVDKTTNPRDGATALLIQDDGGGMDPQAMRHCMGFGFSDKKSDSAIGRYGNGFKTSTMRLGADVIVFSRHSKNQTLTQSIGLLSYTYLTRTGHDRIVVPILDYEFNASAGEFKTLQDREHFISSLSILLEWSPFSTEAELLQQFDDVGPHGTKVIIYNMWLNSDAKLELDFDSVAEDILIEGSIKKTGSKIVNDHIASRFSYSLRVYLSILYLRIPETFKIILRGKVVEHHNVADDLMHPQYILYKPQAAGSEEALVVTTIGFLKEAPKVNLHGFCVYHKNRLIMPFWQVINYSSSRGRGVVGVLEANFVEPTHNKQDFEKTVLLQKLENRLKEMTVEYWSCHCVLIGYQVNKKPRLQIPQKVQPAGRQALSPPPGFQAVFPQGNTTSLPRVSTQPVLLEKRKEHPDSVASAALKRKVGNDDFTVPGHIRVEQFIHGSASQSQDIETVKLMEENKKLRAKCLDRKVRSQNLEVKAMNLRSELENYKSEYERLMVELQALDLVKDEHRRNVNTKGGRAGTEMGYPYDVPDYAGMGYPYDVPDYAGMGYPYDVPDYAGSFGSLEVLFQGPLEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGLEGSMAGGLNDIFEAQKIEWHEDTGGS

SEQ ID NO: 66 - protein, 740 aa, Arabidopsis thaliana
MRSYNLFHESNPTISFSFVGAETMAPNLHIKKAFMAMRAMGIEDARVKPVLKNLLALYEKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGSNPHLPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISKGKNVKKRA

SEQ ID NO: 67 - protein, 783 aa, Solanum lycopersicum
MAPNSKSRVTKAFEAMKVFGYSETVVKPVLRNLLNLYNKNWKLIEDENYSVLLESIIDSEESKEKQKSSMEDEPEENEPPLKRSRLYSQGNHSSAAKHDAGPSVDTCTSELQPYGKQKMADITTESCETQDVEMKPRFLLNHHQRKGKKQISSEASPVSEEDNDIVVLSDDDKQETRILSSHLKLKKRGDTSRLYSAVKPKRRLAYSSSLEEPNVMGSTDVSKEGALVEYSFSDAMPLSDTLPGFDVPLAVVPSDLERLNSEHLGTEGNKEDATNSSRLNIASTPNGEVKLSFVYKIYSSSDFCPPSLDAVFKRMEEKYMKSYRFSQPGFLLSLMENLCKCYLTAGTRTRTANEPSAGIWSQKLHPVGVRYDATNHELHFAPDTSNGSFKLSNLIKILPQIPTFTASGNRDIMCYMVDFNGTRINGAEKDNTNKLLKLLASSTMNNSVLVQSEHSSPGLRNSVYYIEDISNGQEEHKISLINAFSHVLPVFKYIPKNVIFQNAYVKFLLARISDDSCCSNCSGDCLSQDIPCACAGETGGEFAYTSGGLLKEKFLESCISMSCEPQKHGLVYCQDCPLERSKNNSVSGLCKGHLVRKFIKECWHKCGCSRGCGNRVIQRGIAVPLQVFMTADGKGWGLRALEDLPRGAFVCEYVGEIVTNTELYERNTQTASERHTYPVLLDADWGSEGVLKDEEALCLDATYYGNIARFINHRCYEGNLIEIPVEVETPDHHYYHIAFFTTRKVNALEELTWDYGIDFTDHTHPVKAFKCCCGSKSCRDTGL

SEQ ID NO: 68 - protein, 865 aa, Solanum tuberosum
MPVNPRVKKAFRAMKSIGISEEKVKPILKSLLKLYDKNWELIEEENYRALADAIFEKEDSEVAEHKKPENNEVRDMPLVQREEVLEEEAVPEEPERPLKRLRLRYQEGQASPSSNNSSAGTSLKRPRREEEGELSGPRYQNQSQGEANPSSVRKNLRLNETQTSPIASRGQNSVAAKSSHAVKLKEPKTEPGVELSSKQKMSGSLALIKPKDEPYTDDMPQFEVPIAVIHPELSNKGDTSSGNTSRRHSETPELLAIELRGGRDSSEEITTSLNGVKTSRELIEVQDRCHTDVDIASSPSGEVKISINWDPALCRSSDFHTPSVESVMKMVELKCLKSYKILDPNFSLMKLMKDMCECVLELGTQHSPELQSTTDVAAENDFGSRSMTVNSSNGFMNFEIDAGDAQPKIPRPSPPRIGEDYIQAGQIASMGNCGSTPETDQNGIEQTNPWSMEAPCELILGEIGTFDSLNELLNSDLGAGEAQPEIPHLNSYFGEDSTQADHTASMGNCGIAPETSQSRLEEVVSHEATPRDVGSVEVIDITKGQENVIISLVNEVNSNHPPSFHYIASNVVFQNAYVNFSLARIGDDNSCSTCSGDCLSLSTPCACAHITGGDFAYTKEGLIKEEFLKECISMNRDPKKHCQFFCKECPLERSKNEDIIEACKGHLMRNFIKECWWKCGCSKQCGNRVVQRGISHKLQVFMTPEGKGWGLRTLEDLPRGAFVCEYVGEVLTNTELFDRVSRSPNGEEHSYPALLDADWGSEGVLKDEEALCLDATFYGNVARFINHRCFDSNLVEIPVEIETPDHHYYHLAFFTTRKIKAMEELTWDYGIDFDDLEHPVKAFSCHCSSKFCRNMKRPSRSRSRR

SEQ ID NO: 69 - protein, 824 aa, Phaseolus vulgaris
MAPNKRVVAAYRAMGSLGIDESKVKSALKKLLKVFDKNWELIEAENYRVLADAIFEEDDNTVPKLKKKIQSDDVHSTCHSLPSFSNNQEDETESEEAQMHNERAQPLKRLRLRDQESQPLHPLTNSATSPPSKRPKLEDNALHQGSFGKKPQNKPESSDGNPRIEAPSLRLPDDIVDKGKQPASTQVLQRGRKLTSGRSSPSTPSKEPTVESGKFLLPNNMMPRTQALIIPKDEPIDEVPDYEMPIAVIPPEPSSVRDSSLKNGVAGKHVSHVTVTSSECRDGVRDEDASPTSNEEATCNVEIASSTLGEVKLSLSCSSALWGSKFHMPRRDEIIEMMEEKCLFSYKIADPNFSVMKLLRDLCDCMLEFGNNSNNDPEESSILRSNVDVSKESQEPGTLDVVRNKDLDMLSDVSNGPINVSPSAAVASPQSFLLLADLNGVNDAVLDSKMDQTTNDFSQCNVRKELECPISPNSHSLVIVPQDQLTADDIRSFYDISDLTKGEENVEIPWVNEYTNDFPPSFNYIPQNLVFQDAYVNISLSRVGSEDCCSTCAGNCVLSIPCACANKTGGEFAYGSRGLLKEQFLNSCIAISRNPQKHFFYCKNCPLDRIKNDGGLEPCKGHLKRKFIKECWSKCGCGKHCGNRVIQRGMTCKLQVFFTSEGKGWGLRTLEDLPKGAFVCEFVGEILSIKELYERNMKCTGEGKHTYPVLLDANWDSGHVNNKEALCLDAASFGNIARFINHRCFDANLVEIPVEVEDPGHYYYHFAFFTSRKISAHEELTWDYGIDFDDHDHPLKLFQCSCGSKFCRHMKRSNRSNISASISE

SEQ ID NO: 70 - protein, 848 aa, Vitis vinifera
MARNPRVLAAYRAMRALGIAEATVKPVLKNLLRLYEKNWELIEEENYRALADAIFEYEETKQDNILGGETQLHDEPARPLKRLRLRNQESQVSPSLANSSQTLGGAVMKRPKLEDAEQPQTLAERQPQGIAETPEPSVGNIRPELHPVSSPQAHLVNKGKQPALPQPLAVQGRSDLSPTSATKRAESDLLHTQQRLRDKGKEPLSPQIAAKEKRSIPVRSFHLNAEPGIILSPKQKVHDTPALMKPKDEPFTDDILQLEVPIAVIHPDPLHKGNLPENYSTGKLDGPQPPVNSRVDGEDEVNGGPASSSGAGTNCELANISNLEIASSPLGEVKISLSCNSALGKPDFRMPSLDTLLKLVEDKCLRSYKIIDPNFSVTKLMRDMCDCFLELGTHTEESHEGSINTTPTGDLLGKSTAPDAVGSCGDEENFSMSSCITNGSFKIQCSTEVAVPQIPRLLSSSLNGLGDHIQLDSKITENSCRENGQEKETNGPNNANSLSLVVVQQRQLTPDDIRFIHDVDDITKGEEKVRIPLVNETNSEFPTPFHYISQNLVFQNAYMNLSLARIGIENCCSTCFGDCLSSSTPCACACESGGDFAYTLEGLVKEDFLEECISRNRDPQQHQLAFCQECPLERSKAEDILEPCKGHIVRKFIKECWSKCGCSKQCRNRLVQRGITCNFQVFLTPDGKGWGLRTLEDLPKGSFVCEYVGEILTTVELYERNMQSTSRGKQTYPVLLDADWALRGILKDEEALCLDATFYGNVARFINHRCLDANLVEIPVEVESPDHHYYHLALFTTRKVNALEELTWDYGIDFDDQDHPVKTFRCCCGSKFCRNMKRTRSRSALSLG

SEQ ID NO: 71 - protein, 811 aa, Theobroma cacao
MAPNPRVVQAFRSMKEIGITEEKVKPVLKKLLKVYDKNWELIAAENYRVLADAIFEEEDNKVSEPKKGQKCDEEEDTMEEGAVPDELVRPLKRIRLKNQEGLASSSHNNGSTDVAGPFLKKPKVEEDELPPASLRQQSLQCNVGNMTECLPASPGCVSLQPTAPGPVSPHQGGRNKGKQPVAPMPLAVLEGYDQNLHSTQMHVSYKGKEPMSPHVTYNEKGPERVSLALCIKDPAPCPGIITKKRMPDTHALIIPKEEPFTDDMPQDEVPIAVIHPDSLSRRDSPIGHVSTGKSNWQEHPESLFADENVGAGASASMSERHISCELATVPDEIPSSLEIASSPLGEVKISLSYNSALGRSNFQLPSIDELRELMEQRCLRSYKLIDPTFDVIKILNDMCECISELATNSSNQSQEGNVMPALDLLKKSPARDALDAESNKENGCLPAKMLNGALDVQCSSNGCVDNVEGKELVVVQQHQLTSNELRWLHDASDITKGEEKVEISWVNEINKDFPPPFHYISENLVFQNAYVKFSLSRIGDESCCPTCFGDCLLSEQPCACACQAGGKFVYTSAGVVREDFLEECISMTRDPQRQCFLNCTECPLERSKKDDFPEPCKGHLKRKVIKECWSKCGCNKQCGNRVVHRGVNYKLQVFLTPDGKGWGLRTLEKLPKGAFICEFVGEILTISELYARNTEKHTCPILLDAYWGLKGVSKDEEALCLDATGYGNVARFINHRCLDANLIEIPVEVETPDLHYYHLAFFTTREIDALEELTWVSEWDYGIDFDDLDHPVKAFRCRCGSKFCRNMKRST

SEQ ID NO: 72 - protein, 761 aa, Triticum urarte
MGSSRGNRNVRARRAVKAMKLLGISREQTAPVLRRLVELYDDNWQLIEAESYRALADAIFDEQANGGPANGGDQVQGQEELDLELEETGTMPEMFTPEDDDQRPSTSLAVVRKDPDNRITAPRSRTGSRANLLGSDPTQAASPTQTRALSKQRQMQMQMMDEDFQQPVFLREPKPEPVDMDAVDCLNVQPGLIHRSRKRSAPSSEFLALPPPEQTPKQISEGDKNRTTQHCRNREMPTLSVEPANSTMNNGTGSGDGNVQEAPCLDIDIASSPRGDVKMSLKFCIDPSKFHMPALEAVLKMVEDKCLRSHKVLPPDFSIRGLMTEMCQCVVQLGTKHTAEHNTQSDTVGNGSLSENAINRKRKAREEPLVSKGSESGPANSTLAQQHHLALSVSKTIHDITDISKGEENVRISIADESGREKCPPSFYYMPTNAVSQNALISMFLAKIGSEDCCPECFGNCLSAPAPCACARQTGGEYAYTPDGLVKPAFIDECVSMNRFPEEHHRVYCKTCPLERSKNKASPEPCRGHLVRKFIKECWSKCGCNMQCGNRVVQRGIRCNLQVFFTEEGRGWGLRTLDDLPKGTFVCEYAGEILTNTELHERAIQNMQNARYTHPILLDAGWCSGGEPKDEEALCLDGTFYGNVGRFINHRCCDANLAMIPVEVETPDHQYYHVAFFTSKKVEAFEELTWHVCNLCSYRQMSQRARLPKPMYLQRLTNLMDYGIDFDDERQPMKAFECLCGSRYCRGGKERRRSRVTGTAG

SEQ ID NO: 73 - protein, 857 aa, Glycine max
MAPTPSQKERALAACRAMSSLGIDDSKVKSVLKKLLKVYDKNWELIEAENYRVLADAIFEDDDNMEAETGCEEAQMHVETPQPLKRLRLQGQESQPLHPPPNGSPSPSSKKLKLDDNASGKKPQNKPVSSDGNPGIATRPLPPRDGIVDKGKQPASLPLNHRGRRLPSERVPQSIPSREPTVEPGRFLLPNNQMPRTQTLVIPKDEPIDELTDYEMPIAVIPPESSVRNSSIKNGVAGKHSGHVTVTSSQNRDGVGDEDVIPTSKKEATCNVEIASSTLGEVKLSLSYGSALQGSDFHIPSRDQLIKVMEDKCLRSYKITDPNFSVKNLLRDICDCMLEFRNDSNDDSQEGSVISSSVDVSKEPRAPGTLSVVGNKDLDTSSHFSNGSINVKSSDDLVSPGSILPLAHPNGLSDAVPVSKMDRTNDFLQSNVKKDLEDPMSPNSHSLVVVPQHQLTADDIRSFHDANDLTKGEENVEIPWVNETTNDFAPSFNYIPQNLVFQEAYVNISLSRVGSEDCCSTCMGNCVLSSSCACANKTGGEFAYNAQGLLKEEFLEECIAISRNPQQHLFYCKNCPLERSKSDGCLEPCKGHLKRKFIKECWSKCGCGKQCGNRVIQRGITCHLQVFFTSEGKGWGLRTLEDLPKGAFVCEFVGEILSMKELHERNLKCTENGKYTCPVLLDANWDSGYVKDEEALCLDAASFGNTARFINHRCSDANLIEIPVEVEDPGHYYYHFAFFTSRKISAQEELTWDYGIDFDDHDHPVKLFQCRCGSKFCRNMKRYSSKFNLQLLGHHHKPTMIVMKYRAPLQYWSGVLLIDAIIFHHISFSSHWIAWLIVGKALDLLDMRQLQDDSLSP

SEQ ID NO: 74 - protein, 741 aa, Oriza sativa
  Japonica group
MAKPNGKEKTGDTGLSMAPPKISKDRFDAAIRAMADIGILKETAAPVLNNLLNLFDYNWVHIEADNYLALADAIFCDSDPKEGQKRQANETNLDADQSNKKLKTKKRSQNPTSKMHGNDNREFVEAPPQQGRGTLSARTVNGKKVTRAHLELPSSQLLIKEPHTCPSIAKNTTIVENNSAVLCHGQDLQTFEVPVATTCPQVVAPSTRKDARRTSGARHDQKHEGVSGAHERNRAVACSNQEIVSSKDSPSNIEVVLSNYGAGKLSFTYNSSLANRSDFHLPDIKLICKKMEARCLRKYKSLEPNFSFKNLIKDTCQCIVESSGPRHEGIIQTVPALDILSKPSVPQILQSNQANSAFMPPNNVMSLGGTSSSCTVAGVSQNSSNMPVVPHQLHIGANRPPHDVNDITKGEERLRIPIINEYGNGILPPPFHYIPHNITLQEAYVNISLARIGDDNCCSDCFRDCLAQSLPCACAAETGGEFAYTTDGLLKGAFLDSCISMIREPLKHPHFYCKICPNERMKIEVNSDSSNTEMNPGPCKGHLTRKFIKECWRKCGCTRNCGNRVVQRGITRHLQVFLTPEKKGWGLRSTEKLPRGAFVCEYVGEILTNIELYDRTIQKTGKAKHTYPLLLDADWGTEGVLKDEEALCLDATFYGNVARFINHRCFDANIIGIPVEIETPDHHYYHLAFFTTRIIEPFEELTWDYGIDFDDVDHPVKAFKCHCGSEFCRDKTRRSKSRARV

SEQ ID NO: 75 - protein, 736 aa, Oriza sativa
  Indica group
MGSKSNTERARKALEAMKQLGFSKKEATPVLKNLLRLFGNNWEPIEDECYRALADAILDRHQETAADRGCSATRPTPDDDHHPLTLCGASRDVDTETDEPRTKKPRATNSDPQSPPSLTDDQDVPAAISPPSHGASPQFRPQTRASARLRQASPSSVTAAHKRPRQMMDEDFQDSAFLREPKPEPDIDMDAIQGTAATSDCPNAHLGLIDYPLNASSSRVALPLALLPPDQNVPQISGPKKRAIQPCSKVNTGEGSSVIDVASSTMGEVKMSLKCSVDPKFRMPSLEAVFKMVEDKYLHSYKILPPEFSIGSLMNEICQCVVQLGSDHIAEHNTESDVAGNGRCSQNEPMTGSIPFVKPIACEDGGNRKCKSAGESFIVEDSENSSVAKQKTHLALANLKPIHDVTDISKGEERVRISVANEFASEKCPPSFYYIRGNLVFQNAYVNISVARIGDEDCCADCFGNCLSAPIPCACTRETGGEYVYTPEGLVRTPFLDECVSMNRFPEKCHKFFCKSSCPLERSRNEASPEPCRGHLARKFIKECWSKCGCNMQCGNRVVQRGITCNLQVFFTGEGKGWGLRTLDELPKGAFVCEYVGEVLTSTELHERTLQNMNNGRHTYPVLLDADWGSEGVLKDEEALSLDSTFYGNVGRFINHRCYDANLVEIPVEVETPDHHYYHLAFFTTKKVEAFEELTWDYGIDFGDGKDPVKAFQCLCGSRYCRGIRHPRKRGKAAAK

SEQ ID NO: 76 - protein, 720 aa, Zea mays
MGSNTERARKALGAMKLIGFSKKQAIPVLKELLKIFNNNWEPIEDESYRALADAILDRQDSKQTPPSQQGTQAAHADLEPLRSTRDDRQQYLSASLDDTCEDDNETPLVKRPRMGTANFRPELQPPQQSSVSTQGALPASPQTSRRQTRSLTVEPHAAGHEYPLAVNDALVVKEPKPEPQIDRAEDFVAGPNATQLNDGSSEQTSGFGARGNIVHQAQSLGRSLQAAAVCKNGVGSTVQNTHETSIVEVDVASSANGEVKMSLKCSLGSSNFSISMEEVFKMVEEKCLHSYKMLPSDLSIGKLLSEVCQSVVQLGTMHSEVNRDSGSLHNEVVVPFVKPISCEAAVGISDDVAGGSSVLESSEPCLQNSLVAWNPELAHCNQKTTHDTTDISKGEERVRIPVVNEFGSETCPPSFYYIPRNLVFQNAYVNISISRICDEDCCADCSGNCLSAPVPCSCARITGGEFSYTLEGLLKTAFLDECTSVNHFLQEHHRFYCPVCPLERSKNEGSPGPCKGHIVRKFIKECWSKCGCGMQCGNRVIQRGITCKLQVFFTREGKGWGVRTVEDLPRGAFVCEYVGEILTSAELHERAIENARNGKHMHQVLLDAGWGSGVVLRDEDACSLDGSFYGNVGRFINHRCYNANLVQIPVEVETPDHHYHHLAFFTNKKVEAFEELTWDYGIDFDDMEGPSKPFRCMCGSRYCRDPNNPRRMGRAAAKRK

SEQ ID NO: 77 - protein, 739 aa, Sorghum bicolor
MGGKNMERARKALDAMKELGISRKQATPVLKELLATFDNNWEPIEDEHYRALADAIFAREDNKQTSPSQQGAQAAHVDSEPNGSTWDNRQQYFSATHDDTGEDDNETPLVKRPRMGTANFRSEPQPFEPGPQQSTVSTQGALPASPQASRRQSRSLAVVPHAAGHEYPLAVDDALIVKEPKPEPQIDISEVSVGDPLTDRDFLAGPDAIRLDDGSSGSGARGCIVNQPQSLGRSLQPAPVCENGVQSTVQNTQETSFVEVDVASSTNGEVKMSLKCSLDSSNFSISMEEVFKMVEEKCLHSYKVLPPDFSIGKLMSEVCQSVVQLGTVHSEINRDSGSLHNEAVAPFVKPIACEASVGINGNVAGGSSVLETSEPCLQNSLVAWDPELAHRKQKTTHDITDISKGGERVRIPVVNEFGSETCPPSFYYVPRNLIFQNAYVNFSIARIGDEDCCADCSGNCLSASVPCACSRLTGGEFPYTPEGLLKPAFLDECTSVNHFPKEHHRFYCTVCPLERSKNEASPGACKGHLVRKFIKECWSKCGCGMQCGNRVIQRGITCKLQVFFTREGKGWGVRTVEDLPKGAFVCEYVGEILTSAELHERAIENARNGKHMHQVLLDAGWGSGVSRDDEGSGVLRDEEALSLDGSFYGNVGRFINHRCYDPNLVQIPVEIETPDHHYYHLAFFTNKKVEAFEELTWDYGIDFDDVEGPSKPFRCMCGSRYCRDPNNTRRMGRAASKRK

SEQ ID NO: 78 - protein, 978 aa, Artificial Sequence
  Synthetic Construct
MRSYNLFHESNPTISFSFVGAETMAPNLHIKKAFMAMRAMGIEDARVKPVLKNLLALYEKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGSNPHLPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISKGKNVKKRAKGGRAKLGTDYKDDDDKDYKDDDDKDYKDDDDKGSLEVLFQGPLEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGLEGSMAGGLNDIFEAQKIEWHEDTGGS

SEQ ID NO: 79 - protein, 888 aa, Arabidopsis thaliana
MGFVYIVMTGYYKNVHKRKQNQVDDGPEAKRVKSSAKVIDYSNPFAVSNMLEALDSGKFGSVSKELEEIADMRMDLVKRSIWLYPSLAYTVFEAEKTMDNQQVVEGVINLDDDDDDDTDVEKKALCVVPSSSEIVLLDSDDEDNERQRPMYQFQSTLVQHQKNQGDVTPLIPQCSFEEVDLGRGKEMPSAIKAIVEGQTSRGKVLPIENGVVNEKGVYVGVEEDDSDNESEAADEDLGNIWNEMALSIECSKDVARETSHKEKADVVEDCEHSFILKDDMGYVCRVCGVIEKSILEIIDVQFTKAKRNTRTYASETRTKRFGESDNELKFSEEGLMIGGLAAHPTHAAEMKPHQIEGFQFLCSNLVADDPGGCIMAHAPGSGKTFMIISFMQSFLAKYPQAKPLVVLPKGILPTWKKEFVRWQVEDIPLLDFYSAKAENRAQQLSILKQWMEKKSILFLGYQQFSTIVCDDTTDSLSCQEILLKVPSILILDEGHTPRNEDTNLLQSLAQVQTPRKVVLSGTLYQNHVKEVFNILNLVRPKFLKLDTSKSAVKRILAYTPCDVRGRLTGSNSDMASMFNETVEHTLQKSEDFTVKIKVIQDLREMTKKVLHYYKGDFLDELPGLADFTVVLNLSPKQLNEVKKLRREKRKFKVSAVGSAIYLHPKLKVFSDKSDDVSDTTMDEMVEKLDLNEGVKAKFFLNLINLCDSAGEKLLVFSQYLIPLKFLERLAALAKGWKLGKEVFVLTGNTSSEQREWSMETFNSSPDAKIFFGSIKACGEGISLVGASRILILDVPLNPSVTRQAIGRAFRPGQKKMVHAYRLIAGSSPEEEDHNTCFKKEVISKMWFEWNEYCGYQNFEVETIDVDEAGDTFLESPALREDIRVLYKR

SEQ ID NO: 80 - protein, 1157 aa, Ricinus communis
MHYVEKKRLANQKTTSVPQCDVINLEDDPPQSHVIAADIPVIILDSDEEDNGYQKPSHMYSKNSSSEPAHKLSVTVSAVKDCHEVRASWDETRSAPANNDFLVDKRKNTDTKNDAQVKDTEKVKASRDFVGGSLAECNIHANESPYPGMKTDVQVGDSENVKNSASVIVDLLGKCKIQVDSNSYACMDNDIVIKEDSHQDDIEDDGLVTIDTDVNNFENDRSQGHVTAADIQVIIINSDEEDSGYQRHSYLYENGTLSGPAHKLPVKDLTVTDCQGVKDPKDEARHSPANYCFQVNKNEYTDTKNDIQVEDNENVKASKCDVGGSLAECNIRVDEIPHSGMESIVQVRNSKKVKDPCDVIGDSHGKCSIFADVNSYTSMKSTAAIKKENHQIGVEDDAIVENETENDIQIKDNKRDKASRITIGNSPTKCSTQVLYATMENHMVIKEDIHQINAKDNGLAKIDTEGDIQDMDSKEFKASRDTVEGSLDKCNIQVDKRPYAVMKISMAIKEDSQHISVEDNVLSKIDTEDDIQDTVGKRVKALSIKVDDSMYTDMENAMAIEEDNRQIDVEDDGLADIWKEMKFAIEYSKDFAVDPATYGCLEEDAEACDHSFVLKDDLGYVCRICGIIQRSIDTIFEFQYAKKRNMRTYAYEPKYTIGKEPIGGIPVGINSPDLMVTEIAAHPRHKKEMKPHQVEGFNFLCSNLVGDNPGGCILAHAPGSGKTFMIITFIQSFLAKYPNARPMVVLPKGILATWKKEFEKWQVENIPLHDFYTLKAENRSQQLDVLKRWVKERSILFLGYKQLSTIVCDSSKVAAECQDILLKVTLREMRRLMYFNPSQKFKPLFLKLKASRMIINRIMGRVQISRVRKHLKHGGDSAFFDSVEYTLQKDEDFKRKKAVIQDLRQMTSKVLHYYKGDFLDQFPGLVDFTVVLNLSARQKDEVQKLRKLDKFKRISLGSAVYMHPRLKDFSQVCFATREKGSNIDDRTIDALLGNLDVREGVKTKFFLNILRLCESAGEKLLVFSQYILPLKLLERLSAKVKGWSLGKELFMITGDSNTEQREICMEHFNDSPSAKVFFGSIKACGEGISLEDYLTCSRKELISKMWFEWNEHCGDQDFEVKTTDVNECGDMFFESPGLREDLNVLYKRKRRQRGTLK

SEQ ID NO: 81 - protein, 883 aa, Glycine max
MESADDVSASKRPLPTGFSPGPDGPKRLRLSSDSLPYPACDQIEPKTPKNPNVVDYSNPFAITDILDRLENGKFGSVTKDIEALIALKMQIMGPYFAKYPILVNQLLKVVTHHDEETPKLENQQVTGLTHQSVIDLEGEYTEKDVPAVPNTVVIIDSDEEDDRDKKSVIPFHEVVLPRKVAPSPALKVIGYHTYLGESNDLKIEINMADKGNNTRSNKGVYVGAQGEEEDKADTEDDGLQDIWKEMSMAIECSKDVSEDPEPEEEEEEDDNCDHSFVLKDDLGYVCRVCGVIDRKIETIFEFQYKVKRSTRTYASDSWNSKGKADVFGINVAEDDLVVTDIAAHPRHMKQMKPHQVEGFNFLVRNLAGDHPGGCILAHAPGSGKTFMIISFMQSFLGKYPNARPLVVLPKGILSTWKKEFQTWQVEDIPLYDLYTVKADSRSQQLEVLKQWMEQKSILFLGYKQFSSIVCDNGTNNTSLSCQEILLKIPTILILDEGHNPRNENTDMVQSLAKVQTARKVVLSGTLYQNHVREVFNILNLVRPKFLKMETSRPIVRRIHSRVHIPGVRSFYDLVENTLQKDTDFKRKIAVIQDLREMTSKVLHYYKGDFLDELPGLVDFTVVLTLSPRQKPEIQKLKKLSRRKFKINSVGSAVYLHPKLKPLAENCGENSTSDNIMDDLIEKLDMRDGVKSKFYYNMLNLCESAGEKLLVFSQYLLPLKYLERLTMKWKGWSLGREIFVISGESSSEQREWSMEKFNNSPDARVFFGSIKACGEGISLVGASRIIILDVHLNPSVTRQAIGRAFRPGQMKKVFVYRLVSADSPEEEDHNTCFKKELISKMWFEWNEYCGDRAFEVEAVEVKECGDLFLESPLLGEDVKALYKR

SEQ ID NO: 82 - protein, 950 aa, Zea mays
MSQSPGGREGIYYSRQRKPSERNGSVFTPIAAMYPSGHALPDANRNHSLVFGGTSKDWDNIRQFIASLERASENSSAIASKTGGGKSTNHSVEPAEQKGKGDIIVLDSDDEDGDGNSPEHNKLASEMNKELGTSVLASNIAERMATNGSQTFETVHAYGGSKNTQIVPYGQGSALVNQFPLQTSWQPSIQFERVVLTKRPEEQRMQDLVAATIAEKRAETQMFLSLPTERKRRRTDHSLLMLDSFVPKQRRRKGDTGLAPADLSLDLHQTATSQEPDIAIEEEEKRKNDGDGLEDYWKDFALAVESTKLDDVDEAAANEKEDNGKMEDIDCNHDIRIHEDLGHVCRVCGMIVRRADSIIDYQWKKASRRRMNGYGGNSKDADEIDCGTVKLSEDFIVADIAIHPRHAQAMKPHQVEGFNFLVKNLIGDKPGGCILAHAPGSGKTFLLISFIQSFMARYPSARPLVVLPKGILVIWKKEIQRWQVQDIPVYDFYSVKAEKRVEQLQILKSWEDKMGILFLGYKQFSTIVTDDGGSKVTAACRDRLLKVPNLLILDEGHTPRNKETDVLESLSRVETPRKVVLSGTLFQNHVEEVFNILNLVRPKFLRMESSRPIARRIMSQVEIFGRSSKGLADGAFTEAVEGTLLNDENFKRKVHVIRGLRELTRDVLHYYKGAILDELPGLVDFSVFLKLTPKQKDIVHKLEMHDRFKRSAVGSALYIHPCLSGLSEVNAENRAHTLRDDSVDSLMDSINVRDGVKANFFMNILSLANSAGEKVLAFSQYILPMTFFERLLVKKKGWHVGREIFMISGDTSQEDREAAVDRFNSSADAKVLFGSIRACGEGISIVGASRVVILDVHLNPSVTRQAIGRAFRPGQQKKVFVYRLVAADSDEVKVHETAFKKEVIQKLWFEWSEQCTTENFKLGQVDIDDSGDELLDTRAIRQDIKALYRR

SEQ ID NO: 83 - protein, 653 aa, Physcomitrella patens
MNEIDRAFCINTLTSWRTFCVQGKGEVNVEEVTESCEHVYEVKNDVGRACSQCGLIKVDIKDMTFMWRRPCSVRKAFVRGERLDNWNDSGDGVLEEDVRLVGMAQLEAHPSLENAMHPHQLEGFKFLSRNLVEEDSGGCMLAFAPGTGKSFLIISFIQSFMVQVPNARPMIVAPKSMLRPWMQEFKKWEVEEMLVLNLYEADDHVKMLKQWMATPSVLLVGYSQFINPSGEVGKYLTEGPGMIVMDEGHLARTEETKILKSLTRVHTRRRVLLSGTPFNNNFEEFYTTLELVRPNFMSRANAQMFPTLNTFQQIVDTKMNSKQPVLDGQLLKRSTNAGRKAFQDVIGEKFESGKYSNIAKALQQLRVLIEPFVAWHKGQILNSLPGITDLTIMLELTAQQLELVRKNKQNEVRDSLQKRAAAIYVHPILEPVADGVKRSQRDPRLKGDVDVKAGAKLRWVLDMVQQCNDAKEKLLIFSEYLYSLALIENMAVQRMKWSKGLQILRLDGSLPPQERERVQHKFNTDPEVRVLCASIKACGEGISLVGASRVILLEVLWNPSVPRQAISRAFRIGQQRKVVVYRLIAAGTYEEMNMHAAATRKEWLSRLLFDPTIPCDDPNSILWDVTKDCSDSFLAYKQSKLREGVRSIYQREF

SEQ ID NO: 84 - protein, 748 aa, Sorghum bicolor
MQDLVAASIAEKRAETQMFLSLPTEKKRKRSDLSLLMLDSFVPKQRRKSDTGLAAADLSLDLQQPAKSPEPEPEPDMAIEEEEKCKNESDGLEDYWKDFALAVESTKLDEVDEAANEKEDNGNMEDIDCNHDIRIHEDLGHVCRVCGMIVRRADSIIDYQWKKASRRKTNSYGGHSKDADEIDCGTVKLSEDFIIADVAIHPRHAQTMKPHQLEGFNFLVKNLIGDKPGGCILAHAPGSGKTFMLISFIQSFMARYPSARPLVVLPKGILGTWKKEIQRWQVQDIPLYDFYSVKAEKRVEQLQILKSWEDKMSILFLGYKQFATIVTDDGGSNVTAACRDRLLKVPNLLILDEGHTPRNRETDVLESLNRVETPRKVVLSGTLFQNHVEEVFNILNLVRPKFLRMESSRPIARRIMSQVEISGRGSKGFADSAFTEAVEGTLLNDENFKRKAHVIRGLRELTKDVLHYYKGDILDELPGLVDFSVFLKLTPKQKDIIRNKLESHDRFKRSAVGTALYIHPCLSQLSEVNAENRANTLRDDLVDSLLDSINVKDGVKANFFMNILSLANSAGEKVLAFSQYILPMKFFERLLVKMKGWHVGKEIFMISGDTSQEDREVAVDHFNNSADAKVLFGSIKACGEGISLVGASRVVILDVHLNPSVTRQAIGRAFRPGQQKKVFVYRLVAADSDEEKVHETAFKEVIPKLWFEWSEHCTTEDFKLGQVDIDDSGDELLDTKAIRQDIKALYRR

SEQ ID NO: 85 - protein, 872 aa, Oryza sativa
MDTPLEQKQKDSSAIIVLDSDDEDEAERCEQLASENNKQQAPSGPTSPCTTWIVSSAKDQVNGTLHVDGVQSTQIVPYGQNAPLINQSPLQTSWQPSIQYERVILQRRPEEQRVQDLVAASHAEKIAETQVFLTLPTLPNERKRRKSEPTTLVDGDGGTNLGKGKRKNHQNQAAVDSILDLQQTVVPLQQNDVPSQSYRTMIEEEKPVKESDGLEDLWKDFSLAAECTKLDTNEDMSNEKDVDDENEMDDDCNHDIRIHEDLGHVCRICGMIVRKAETIIDYQWKKASRTRTNYYESRSKDADDIDTGAVKVSEDFIVSDIAIHPRHAKQMRPHQLEGFSFLVKNLVGDKPGGCILAHAPGSGKTFMLISFIQSFLAKYPSARPLVVLPKGILGTWKREFQRWQVEDIPLYDFYSVKADKRTEQLEVLKSWEARMSILFLGYKQFSRIICGDGDGNIAAACRDRLLMVPNLLILDEGHTPRNRETDVLASLKRVQTPRKVVLSGTLFQNHVSEVFNILDLVRPKFLKMESSRPIARRIMSQVAISGIRSLKGVHDSAFTESVEDTLLNDDNFTRKSHVIRSLRELTKDVLHYYKGDILDELPGLVDFSVFLKLSTKQKEIVHKIEAYEKFKRSAVGTALYIHPCLSEISEGDAADRATNLTDATVDSLIESIIIKDGVKAKFFFNILSLANSAGEKLLAFSQYILPMKFLERLLVKRLGWHVGKEIFMISGDTSADDREVAMDQFNNSADAKVLFGSIKACGEGISLVGASRVIILDVHLNPSVTRQAIGRAFRPGQQKKVFVYRLVAADSPEVKFHETAFKKEVIPKLWFEWSELCTTEDFKLNQVDIDDSEDELLEANAIRQDIKALYRR

SEQ ID NO: 86 - protein, 984 aa, Brachypodium distachyon
MAAAGEDPQEPHSGDCERLPLHHHLLLSHLVVVSPSAPAVGSDLEFGLVEAGKGMYYRRKNRASDPISGLSLPAGSGVHSWGCGSVTKDMEDIYARNVQLINFLSTLHEPTRSSVPMVETNVKYCSIKQETKVTDCSVKQTEPILIPDSDDEDGSTAELAPEKNKELIPLGLAGTLTAHVTSKGKDQVNETRHYGYQNSQIVPYGQSAALINHHSLQTSWQPSIQYESVILQTRTEEERIKYLAAASHAEKMAETQVFPDLPRERKQRKLDPNSQVDGDAGTAPRKRKRKTGPDPAAVDLPSETYNPVEEEEPAEEDKPENKSDGLEDLWKDFSVAMESSKLNTFEELPDEKELGEKDVDNDCNHDIRIHEDLGHVCRVCGLIVRRADTIIDYQWKKASRSRSYFCGTRSKDADEIIIGDIRVSDDLLALDIAIHPRHKKQIRSHQLEGFHFLVKNLVSDKPGGCILAHAPGSGKTFMVISFIQSFLAKYPSGRPLVILPKGILGTWKKEFQQWQVEDIPLYDFYSVKAEKREDQLKILNSWQSKMSILFLGYKQFSTIICGDGGGTVAAACRDMLLMVPNLLILDEGHTPRNTATNVLESLSRVQTPRKVVLSGTLFQNHVGEVFNILNLVRPKFLRMESSRPIVRRIMSQVAISGTRVSKGVPDNVFTESVEETLLHDENFTRKAHIIRSLRELTNDVLHYYKGDILDELPGLVDFSVFLKLSPRQKEIVHKLEAYEKFKRSAVGTALYMHPCLSEMSEGDATDRANNLTDAAVDSMVQSINVRDGVKASFFINILRLASCAGEKLLAFSQYILPMKFLERLLVKTWGWHVGKEIFVISGDTSPEDRELAMDQFNNSADAKVLFGSIKACGEGISLVGASRVVVLDVHLNPSVTRQAIGRAFRPGQQKKVFVYRLVAADSAEESFHETAFKKEVIPKLWFEWSEQHCTTDDFKLNQTDIDVCGDELLDNQAMRQDIKALYRR

SEQ ID NO: 87 - protein, 859 aa, Populus trichocarpa
METPLNILPLKRAAPNESRFNGNKRMKQMKEKVTDYSDPFAIHGLLDRLDSGRYGSVTDDIRSLFNRKAQMIHTFLVMYPELANESRGRGMSFSEEKCNVIDLDDGDDDEGGGGNVAAGRMPVVVIDSDDEVESNENRMAGHFQGIVLPKPEGQFLTDLMFSDHAERRIHGEVVSLTGEPDITKDKGVYVGVEEDEVDTGIEDDGLGDIWKEMSFALESSKDVVENPQPDENMEEDEDYCDHSFVLKDDIGYVCRICGVIEKAIDTIIEIQFNKVKRNTRTYMSESRNAKDRDSNGMVGVDLFEEDLTLTDIPAHPRHMKQMKPHQVEGFNFLRNNLVADNPGGCILAHAPGSGKTFMIISFMQSFLAKYPHAKPLVVLPKGILSTWKKEFQIWQIEDIPLYDFYSVKADSRHQQLEVLKQWLEHKSILFLGYKQFSSIVCDDGKNQVSVTCQEILLRRPSILILDEGHTPRNENTDVLQSLAKVQTPRKVVLSGTLYQNHVKEVFNVLNLVRPKFLRMDTSRGIVKRILSKVNIPGARKQFKAGADAAFYDLVEHTMQKDQDFKRKVTVIRDLREMTSKVLHYYKGDFLDELPGLVDFTVVLNLSSKQKHEVQKLKKFAGKFKRSSVGSAVYLHPKLHSFSENSAVTDDMMDNLLETLDVRDGAKAKFFLNILSLCKSAGEKLLVFSQYLTPLKFLERLVMKVKGWILGKDIFVISGESSSDHREWSMDRFNNSIDAKVFFGSIKACGEGISLVGASRIIILDVHLNPSVTRQAIGRAFRPGQTKKVYAYRLVAADSPEEEDHTTCFRKEAIAKMWFEWNEYCGYQDFEVETVELDDSGDCFLESLLVRDDVRLLYKR

SEQ ID NO: 88 - protein, 903 aa, Vitis vinifera
MHSEPKQKRQKAGPNVVDYSDPFAIPNLLEGLDAGRFGSVTKEIEALCARRMQMLQPYYVMYPSLSYMCTDLGKKQGKKASKLVNREASHLAHEDVIDLEDDHVVDDALTATAVEDATLPVVIIDSDDEDCGDQKVSHPPQETAWPSFSYQEVVLRKPSVGLLANNPVVRDYVGSIAPKVEEGSLMGATEIRKDKDVYIGVGEKSLVANLEMKKVQGEYVGVEDDMETNEGNLRAKTEDDGLADMWQEFDLALQSSKDVAVDPGEDEKESKEECEHSFVLKDDIGSVCRICGVVNKSIETIIEYQYTKVKRSRTYMYEPRNTKDREPTDDPSDGLGFSEHNLTVTEIHAHPRHSMQMKPHQVEGFNFLVSNLVAENPGGCILAHAPGSGKTFMIISFMQSFLAKYPQARPLVVLPKGILATWKKEFLTWQVEDIPLYDFYSVKADSRPQQLEVLKQWVAEKSILFLGYKQFSSIVCGDGASKATIACQEILLKAPQILILDEGHTPRNENTDVLYSLAKVQTPRKVVLSGTLYQNHVKEVFNILNLVRPKFLKLESSRAVVKRIMSKVDIMGVRKQLKSNAADAFYDLVENTLQKDDNFRRKITVIQDLREMTSKVLHYYKGDFLDELPGLVDFTVLLNLSARQKKEVGNLNKFERKFKKNSVGSAVYLHPQLKYFAEKLAANESKTDEMTCQKKMDEILEQLDVRDGVKAKFFLNVLALCQSSGEKLLVFSQYLLPLRFLEKLTMKVKGWSPGKEIFAISGESSSEQREWSMERFNTSPDARVFFGSIKACGEGISLVGASRVLILDVHLNPSVTRQAIGRAFRPGQKKKVHVYKLVAADSPEEEDHNSCFKKELISKMWFEWNEYCGHHEFEAETVDVSDSGDLFLESPLLREDITVLYRR

SEQ ID NO: 89 - protein, 903 aa, Cucumis sativus
MDATIDFSHNSYATTNGLYYGKHKRLKLSSDGKDLSSTATFSAKKSNTLRQNKMNNSAKVIDYSDPFATNNLIDGLDCGHFGSVTKEIGALVSRKMQVLSPYIAKYPALSSMLFDLGRSRECKEAMNNQASQLVHNLIDLEDDSAIDVRSNNVEKSRLPILIIDSDEEDSKEQRVIHPFQEVVLPRPPGQSLFKDIAIVDHRTSRDRRASNGEEATPIGESGTINKDKGVYIGVEEDEDEVSGQANSEDDGLGDIWNDMQMALECSKDLDAAVDSSSNQPTTEDVDCEHSFLLKDDLGYVCRICGVIDRGIETIFEFQYNKGKKSTRTYISESRNKDSGNIVGVKISEDDLTVTEISAHPRHMKQMKPHQIEGFNFLISNLVSDNPGGCILAHAPGSGKTFMIISFMQSFLAKYPQARPLVVLPKGILATWKKEFQIWQVEDIPLYDFYSVKADNRAQQLTVLNQWVEHKSILFLGYKQFSTIVCDVETSAASTACQNILLQVPTILILDEGHTPRNENTDTLQTLAKVRTPRKVVLSGTLYQNHVKEVFNIVNLVRPKFMRSETSRPIIKRIMSRVDIPGARKQFKAGVDAAFYDLVEHTLQKDTDFRRKVSVIHDLREMTSKILHYYKGDFLDELPGLVDFTVVLNLTSKQKHEGEKVKKFNRKFKISSAGSAVYLHPKLNVFSVNAAVTDDKIDEVIDKMDVKDGVKTKFFLNLLNLCATTGEKLLVFSQYLLPLKFMERLVVQKKGWSPGRETFMISGETTPEQREWSMERFNNSPDARVFFGSIKACGEGISLVGASRIIILDVHLNPSVTRQAIGRAFRPGQTKKVFAYRLVAGDSPEEGDHSTCFKKELIAKMWFEWNEYCGYHDFEVETVDVKQCGDNFLETPLLGQDVKVLYRR

SEQ ID NO: 90 - protein, 815 aa, Arabidopsis lyrata
MFVFAKKLKSLPASKHERSEANQKSSSLRCHIQFLFIFLKFSSKVPTFNSLMEILHPDQATSNGFYKNVHKRKQNQVDDGLCSDSEAKRLKSSSKVIDYSNPFAISNMLEALDGGKFGSVTKELQEIADMRMDLIKRCIWLYPSLAYTEFEDEKTMLSLDNQQVVEGGVINLDDDDDDDDDVSNKAICVVPSSEIVVLDSDDEDNERQRSTYQFQSTLVQLQKNQGDVTPVTPQFTFEEVDLGRSKEMMPSVIKAIVEGQTSRDKVIAIENGVANEKGVYVGVEDDDIDNESEAADEDLGNIWNEMAMSIECSKDIAWETSHKQKADVVEDCEHSFILKDDMGYVCRVCGVIEKSILEIIDVQFTKAKRNTRTYASETRNKRFGESDAELKFSEEGLMIGGLAAHPTHADKMKPHQIEGFQFLCSNLVADDPGGCIMAHAPGSGKTFMIISFMQSFLAKYPQAKPLVVLPKGILSTWKKEFLRWQVEDIPLLDFYSARAENRAQQLAILRKWMEKKSILFLGYKQFSTIVCDDTSTDSLSCQEILLKVPSILILDEGHTPRNEDTNVLQSLAQVQTPRKVVLSGTLYQNHVKEVFNILNLVRPKFLKLDTSKSIVKRILSYAPISDVRSHMGNNSDVSSAFNEIVEYTLQKSEDFTMKINVIQDLREMTKKVLHYYKGDFLDELPGLADFTVVLNLSPRQLNEVKKLRREKRKFKVSAVGSAIYLHREAETIGRAFRPGQTKKVHAYRLIAGSSPEEEDHNTCFKKEVISKMWFEWNEYCGYRNFEVETIDVDDADDMFLESPTLREDIRVLYKR

SEQ ID NO: 91 - protein, 163 aa, Arabidopsis thaliana
MQSSMTMELRPSGDSGSSDVDAEISDGFSPLDTSHRDVADEGSLLRRAEMYQDYMKQVPIPTNRGSLIPFTSWVGLSISMKQLYGQPLHYLTNVLLQRWDQSRFGTDSEEQRLDSIIHPTKAEATIWLVEEIHRLTPSHLHMALLWRSDPMYHSFIDPIFPEK

SEQ ID NO: 92 - protein, 175 aa, Ricinus communis
MKRTMPWNEQIDVISSDESTSSDGDMETDVVLDGHKPSPRITISQSLKEITSEDVLIRRAEMYQDYMRQLPIPVHHGSVIPFSSWVGLGKSIKQLYGQPLHYLTNILLKQWDQLRFDNGDEQKSLDIVIHPCKAEASVWLVEEIHRCTSSPHYVAKLWLLDPMHHAFVDSIFPPL

SEQ ID NO: 93 - protein, 165 aa, Glycine max
MKRSFPWENQIDVSSSSSPNSLRPNPLTIPNSPIDTKSQDALIRRAEMYQDYMKQIPIPNHRGTMIPFTSWMGLGRSMKQIYGQPLHYLTNILLKQWDQLRIGSEDEYKPLDNIVHPHKAEATIWLIEEIHRQTSSHFHLASLWKVDPMYNGFVDSIFPTLEHTS

SEQ ID NO: 94 - protein, 218 aa, Zea mays
MKRAAPSQEPLDVSSGDSSGSDSDQLGGKDKGGSASKAAAGAEDVKRVVLHKESQDVSSDDDLSSDSDDDAGKGNAWNAFGLPNSSKAASTAEGALIRRAEMYQQYMKRIPVPAYRDSVIPFTSWLGLAGSLKQLYEQPLHYLTNVLLKKWDQQRIGSDDEHRRLDAIIHPARAETLVWATEEVHRLTTSGQHLASLWASDPMYHAHVDPVFASVKLE

SEQ ID NO: 95 - protein, 179 aa, Medicago truncatula
MKRPFPWDEDEIDVSDSSSSDDSPNETPNVATVLPSIHIHIPLPNPSSDVNSLDALTRRAAMYQDYMKHIPIPSSRGSLIPFTSWMGLGRSIKQLYGQPLHYLTNILLKQWDQLRIGSEDEYTPLDDIIHPRKAESTIWLMEEIHRQTSSHFHIADLWKKDPMYHGFIDSIFPKLEDTS

SEQ ID NO: 96 - protein, 173 aa, Oryza sativa
MKRAAPWEEPLEVSSDDSLSSDSDDEAGKGKGDNAFGLPNSTKAAAPDGALIRKAEMYQEYMKHIPVPAHRGSVIPCTTWLGLGRSVKQLYKQPLHYLTNVLLKQWDQQRVGSDDEHRPLDAIIHPVKAEALIWITEEVHRLTTSSQHLASLWASAPMYHAYIDPVFPPIKLQ

SEQ ID NO: 97 - protein, 175 aa, Populus trichocarpa
MKRTIPWTDPVDVISSDESSSSDSDIELNDGLDGQRLSNYVTIDQPIKETTSEGVLIRRAEMYQDYMRHIPIPVQRGSAIPFSSWAGLGKSIKQLYQQPLHYLTNILLNKWDQQRIGSEDEHTPLDIMIHPCKAEATIWLVEEVHRRTSSHHHVAKIWQSDPMHHAFVDSIFPKL

SEQ ID NO: 98 - protein, 137 aa, Vitis vinifera
MDITIDQPARQEPFEDVVIRRAEMYQEYMKQIPIPARRGSLIPFDTWMGLAKSIKQLYGQPLHYLTNILVKQWDQLRIGSKDENRSLDSIIHPSKAEASIWLIEEVHRQTTSPHHMAKLWLSDPMHYAFVDSIFPQI

SEQ ID NO: 99 - protein, 174 aa, Cucumis sativus
MKRPMPWNEQVDIISSGESSSSDSEAAIQNDGYEFKPSLDDFKIPAKEMTSEGMLMKRAEMYQEYMKQIQIPAQRGSVIPFTTWMGLGKSIKQLYGQPLHYLTNILLKQWDQLRLGSADEYKPLDTVIHPSKAEATVWLVEEIHRRTSSHHHVAKLWLSDPMHQAYVDSIFPQL

SEQ ID NO: 100 - protein, 167 aa, Arabidopsis lyrata
MQSSMTLELRPSADSGSSDVDAEISDGFSPLDNSHRDVADEGSLLRRAEMYQEYMKQVPIPTNRGSLIPFTSWVGLSISMKQLYGQPLHYLTNVLLQRWDQSRFGTDSEEQSLDSIFHPSKAEATIWLVEEIHRITSSHLHIASLWGSDPMYHSFIDPIFPKIETSS

SEQ ID NO: 101 - protein, 710 aa, Arabidopsis thaliana
MADMRRRNGSGGSSNHERNEQILFPKPETLDFDLPCDTSFPQQIGDNAASSSGSNVKSLLIEMGFCPTLVQKAIDENGQDDFELLLEILTKSTETEPPGPSFHGLMEPKPEPDIEYETDRIRIALLTMKFPENLVDFALDRLGKDTPIDEMVDFIVAAQLAEKYAEESEDSLDGAEINEEDEDVTPVTARGPEVPNEQLFETMDKTLRLLEMGFSNDEISMAIEKIGTKGQISVLAESIVTGEFPAECHDDLEDIEKKVSAAAPAVNRTCLSKSWRFVGVGAQKEDGGGGSSSGTANIKPDPGIESFPFPATDNVGETSRGKRPKDEDENAYPEEYTGYDDRGKRLRPEDMGDSSSFMETPWMQDEWKDNTYEFPSVMQPRLSQSLGPKVARRPYFFYGQLGELSPSWWSKISGFLFGIHPEHVDTRLCSALRRTEGYLHNLPTVNRFNTLPNPRLTIQDAMPHMRSWWPQWDIRKHFNSGTCSNMKDATLLCERIGRRIAECKGKPTQQDQTLILRHCHTSNLIWIAPNILSPLEPEHLECIMGYPMNHTNIGGGRLAERLKLFDYCFQTDTLGYHLSVLKSMFPQGLTVLSLFSGIGGAEIALDRLGIHLKGVVSVESCGLSRNILKRWWQTSGQTGELVQIEEIKSLTAKRLETLMQRFGGFDFVICQNPSTPLDLSKEISNSEACEFDYTLFNEFARVTKRVRDMM

SEQ ID NO: 102 - protein, 678 aa, Ricinus communis
MQLISFSNSNAVLSWLTAEASGHDKMRKVHNGETSSNQKTTVPKPEMLDFDFPSDFIYSSQLGETAASSSASDVRSFLTGMGFLPSLVDKVIQENGEDNVDLLLEILMECSDPQKSNSQSSDSLDTLFNDKDASNPPEYSKFGQPKEEPDVFGFDDSKRASLLHMNFSAEEVDFAMEKLGTDAPVDEIVDFITAAQVAANFDEERDDELEHDVEQNKYCSRHSRMNPSHVARGGESFNMEIRDEQRRDSYGRKKPENLSQEAVSRSSNLNLEEIHRGKRPKQEYTEGYSNTQDEHFGFEENYEEEGPKPEYTADSSFSFESAWVEEKVDTEITGFRIPREPKFKSCKSVDRMVAKPPYFLYGNVATVSLDTWGKISQFLYAVEPEFVNTQFFSALSRKEGYVHNLPTENRFHILPKPPMSILDAMPHIKKWWPSWDTRKQLSFINYETNGLSQLCDRLGRMLTDSRGLISSQQKRDILHHCHKLNLVWVGLHKVRPIEPEHLELILGYPLNHTQTTEGSLTERLHALRYSFQIDTLGYHLSVLKSMFPEGITVLSLFSGIGGAEVALHRLGIHMKGVVSVETSETKRKILRMWWRNSGQTGELEQIEDIQKLTTKKIDRLIERFGGFDFVICQSPCTCASGNPKMEQRADARSALDFSLFCEFVRVLQRVRTQVQRKR

SEQ ID NO: 103 - protein, 694 aa, Glycine max
MAGNPNRREGKTVMVPKTENLDYELPPYTSFSGDVGDNVASSSGGKLRAFFIGMGFLPCLVDKVIEENGEENSDILLEALLRYSALQKSNSQSSVSLDSLFDDKDPPEISNVNQAKEEPDELSGVVDDTRGSLLMMNFSVEEVEFAIHKLGDEASIPELVDFIFALQIAKKLKKEPDDITFTYYGRGNEVTNEKLFGIMAKTLQLFEMGFSENEVSSAIDKLGSEAPISELANFIFAEQNGIDYVMEYKFPTTSTYSVGIKEEPEMDLYGTAEVKVEGFSHEPPQSSQVNLEETYNDDMVKEEEGIDAFPSNVSDQYLDVVENGRGKRPKYEHDDDPVNCLEPSWVEERVDAVVAEMSRHPKPNPSRCLSSVAAKPPFFLFGNVSNISYDSWTKMSQFLYGIEPEFANAQSFSAMDRIEGYIHNLPVENRFHILPKPPMTIEDAMPQTKKWWPPWDSRKLLSSIYCETNGIAQTCDRLGNFLADSGGVLTSEQQKDILRYCRRLNLVWIGKFKLGPVEPEQLELILGYPLNHTRATEGNVAERLKSLKYCFQTDTLGYHLSVLRPIFPHGLTMLSLFSGLGGAEIALHRLAIKIKAVVSVETSETKRKILEKWWRQSGQTGTLVQIEDIQKLTSKKLEGLISKFGGFDLVIYQNPCSYSSSRLQAGVGLSALDFSVFCECVRVLQRVRGMYQRK

SEQ ID NO: 104 - protein, 659 aa, Zea mays
MVKVEDQAEDGGADADARGLRESALDPLPVSVHASLKEEEGQPSSSSGKLRSQFIGMGFSSKLVDKVLQRHGDDDSNTILESLLSYSDLQQSGSESSDSFGSFFDNDNEENNSPSESRKGIYQDIKPELDSFSEKWSFLLRTMNFSQQEVDLAFKQLGDEAPLEQLVDFIVSAQSGVPSGGLQTGDATNEGKTELLYGVMEKTLSLLQMGFTEEEVSSAIDNFDQRATVQELADSILARRIANSIEQKEIKVESDFLDEAETDYSSYQPSYSDVSYYDDDNNNTRVKRAKHIFIDDIGASSSHLGDPWSMGQRAGTNDMSVKVELEAMTPGRRANVQGDLAKPPFFLYGNVVEVPKDTWHQLKQFLYNVEPEFVNSQSFSALTRREGYIHNLPVEKRSVVVPKSPMTIEEALPFTRQWWPSWDTRKHISVITTEAAGIEQTCERLGGMVRESRGVLSQARQMQIIHQCRVSNLIWVGRDRLGPLEPRQVEKILGYPYNHTNLFELNQPDRLAAMKYAFQTDTLSYLLSVLKGKYQDGIRVLSIYSGIGGAEVALHRLGIPLKCVISVEESEVNRKILRRWWLKTEQTGVLRQHAGIWKLKTHVIEDLVKEFGGFDLIIGGNYTSCKGGTTVNTTMGMDSNRFYEYNRVVKRVRTAVGLS

SEQ ID NO: 105 - protein, 1032 aa, Medicago truncatula
MTGTSNGRGGKNPVFPKTEDFDYELSPYTALSRDFRETAASSSGSKVRGFFIGMGFLPGLVDKVIEENGTLCVSEENSDALLEILLRCSTNGDSSDSLEGSLNTNEHRSIPNFFPNAHSKEALQISNLESSDSLDSLFDDKDSPEVSMINQPKEEVDEIFEDIEDSRGTLLMMNFSAEEVEFAIRKLGNKAPVPELVDFIFAAQIAKKMKKEEAEEDDIKCYVREKEISNEQLFGIMAKTLQLFEMGFSENEISSAVDKLGPDVPISELANFIFAEQNGIEYVMEYKYPSGPSYSWIKEEEQSDMYGTAEVKVEDFSHEPSQSRQVNLGETGTGERVKEEDYIDEFPDDVKPGFMENDRNKRPKYEYDDNSNSSLDPYWVEEMVDTVVATMSRRNKSTPSRSLSSVAAKPPFFLFGNVSNITYDSWKKMSQFLYCIEPEFVNTELFSALNRIEGYIHNLPTENRFQILPKPPMTIEDAIPRTKKWWPPWDSRKKLNCNYCETGGITQLCDRLGRALANSGGILTSQQQKDILRYCRGLNLVWTGKYKLGPIEPEHLDHILGYPLNHTRTDECDLTERLQLLKHSFQTDTLGYHLSVLKPIFPTGVTLLSIFSGIGGAEVALHRLGIKIKALVSVETSATKRKILEKWWRSSGQSGTLVQIEEIQKLTSKKFENLINNFGVFDLVIYQNPCSQPIVRPHQVGGLSAVEFSAFCESVRILQRVRALCERREMTVSLPVLSEVIWKVLVGLVKQGDDSFTSSVVRSDMEGSMVDRCPRYDIKKVGVLRWGYCRREEGKNANESGEATAKSAKGVIVIEGLITSLALALGLESELANLVALEDCTQLDLHSCMNQKFVQVKGKIQFYLMIKNELVRSIVLPNREQINVRNENNWLFDLEAPESPLAAHPAAAYRADDAHEGGGTDDEYDRQERLSPAHSYPHLTPSPDRHIPPHTQAPDYTPHLPHICTLVSTSYTSQSSVEYELNALRPEVANLRATQQERSDRETERDHQMRVNNHMIRQMFTWITRHDMPPAE

SEQ ID NO: 106 - protein, 576 aa, Sorghum bicolor
MADRVGGSDDGDKSEWNSDGEVARSLDGAGSPIAPSRNKLKDAPGPSLLVNGAGPSASLVEDFVGMGLIKGNGDGGAESLLELLLAYKAIGNDPSLDKSSASVCGPRTICDDKDILANWDAHDASTSSDRDHASDDSGDEDFLQGLSQKDEKIESLVRMGFPKDEAEMAIVRCGQDAPMSVLIDLIYSSEASEDGYYGNFSGHEDDSFGGRKEKRKRSEDAEQGSSHDEPMPLPNPMVGFNLPNVSLRSVDRSLPSKAIGPPFFYYENVAIAPKGVWTTISQFLYDIQPEFVDSRFLCAAARKRGYVHNLPIENRSPLLPLPPKTIFEAFPHTKKWWPSWDPRKQFNCLLTSMAKPKLTEQIHHALAKCKDPPPRRVQKYVLETCRTANLVWVGLNKVAHLEPDEMEFLLGFPKDHTRGIGRPERFKSLGNSFHVDTVAYHLSALRDMFPHGMNVLSLFSGIGGAEVALHRLDIRMKTVVSVEISETNRFVLRTWWNQTQTGTLIEITDVQSLTTERLESCIRRIGGFDLVIGGSPCNNLAGRNRFHRDGLEGEQSSLFYHYYRILDTVKSIMGRM

SEQ ID NO: 107 - protein, 680 aa, Oryza sativa
MVKVEDDVEGSGINASVGDLRDAAVNPQPALLRATVKEEEGQPSSSSSHVRSQFIGMGFSPMLVDRVLQKHGDRDSDTILEALLSQSALQKSGSESGSLGDLFDSDNEENSSHFAPRKEVIQDIKVEADSSSEKRSYLLSTMNFSQREVDLALNQLGEEASLEQLVDFIVTGQVSGCSGGNENGDASNEVKDESLFGVMDKTLHLLQMGFTEEEVSSVIDKAGPEATVLELADTIFARRIASSIEQKEVKVEPDFLDETETSYSAYHPSNSGLRYYDDDHDNIRIKRAKHMFIDDSAGSSSRAGNQPNLDPWLKDHRATTSDGSVKEEFDAMTPGIRRNVRSDVANPPYFLYGNVVEIPKATWRQLSEFLYNVEPEFVNSQFFSALSRKEGYIHNLPTEGRRNLVPRSPMTIEEAFPFTRQCWPSWDTRKQLNSVATEVAGIEQLCERLGKMVRDSGGYLSQEKKTHIMHQCKLANLIWVGPDRLSPLDPQQVERILGYPRKHTNLFGLNPQDRIEAMRYSFQTDTLGYLLSVLKDLYPDGLRVLSIYSGIGGAAIALHRLGIPLQCVVSVDQSDTNRKILRRWWSNTEQKGQLRQINTIWKLKINVLEDLVKEFGGFDIIIGGNFSSCKGGTTVNSSMGMDSNQFFEYVRVVQRVKHIMGRLQVRAHESARHRHRSPSN

SEQ ID NO: 108 - protein, 660 aa, Brachypodium distachyon
MVKTEDQDEDEGVSASVGALRDGTVDPQPDTAHAGVKAEEDGQPSSSSSYSKFIGMGFPPTLVDKMLQKHGDKDFNAILESLLFHSSLTKSGSESSSSLGSLFDSDSEENISRLGSMKEPHEEIKPEPDSFSERRSYLLSAMNFSQQEVDWAFNQLGEEAPLDQLVDTIVTAQVAGFTGGNENVDATTEGKAESLFGVMEKTLHLLQMGFTEEEVSGAIDSSGQEATVQELADSIFARRIDNSIKQTEVKIESDFLGGTENQHSTCHQRLRYYDDEDDKIGVKRAKSIFTDNSSGASSSRPGNQPSLTPWLSGCTGSVSNGYVKEEFDAMASGPRPDVRPEIAKPPYFLYGNVVDIPKGTWHQLSDFLFNVEPEFLNSQYFSAVMRREGYLHNLPMETRHIVVPKSPMTIEDALPFTRQWWPSWDTRKHIGVVTLDVAEIEQMCEKLGKIMTDSRGVLSHEKQAHIMQQCKMSNLIWIGKDRLSPLEPHQLEHILGYPRNHTEQFELNTPDRLAAMKYTFQTDVLAYLLSVLKSKYPNGLRLLSIYSGLGGAEVALDRLGIPIKCIVSVEESDVNRKILRKWWRRTNQAGELRQFVGIWKLKTIVLEDLVKEFGGFDLIIGGNYSSCRGGRTINATMGMDSNKFYEYARVVKIVRALHNS

SEQ ID NO: 109 - protein, 661 aa, Populus trichocarpa
MGYSPSLVNRVIEENGEDNVDLLLEILMECSGLQKPNSQSSDSLDCLFDDRGESSPPKYSTVTGVKEEPDVFDEVYDDKRVSLLKMNFPAKEVELAMDKLGENAPINEIIDFIIAAQIANNLDRETEDMPDIDAENKEDVNDETLYGTMDKTLCLLNMGFSENEVSLAIDKFGSEVPVTELANAICAHQLGETYVIKKKYSENSTASCSSAAEDSRSFGVETENNTRHHSFSWVKSETEDCRRDAILQSRDMNTKETRKGKRPRQEHIEGYQEAQPRHDSLEENCAGEQPKQEYDYGSSSYFEHEWVEEKVNSDTTTFGMPKPFKCNPCKILDQIAAKPPYFFYGNVATASSDTWGKISQFLYGIEPEFVDTQFFSALSRREGYIHNLPTENRSHILPKPPITLEDLMPSTKKWWPSWDARKKMSCRNFDSSGSSQLCDMLGRMLDDSRGLLSAEQQRDLLRHCQALNLMWVGPNKLSPLESAHLEKILGYPLNHTLIADYPLTERMYSLRYSFQTDTLGYHLSVLKSIFPQGITVLSLFSGIGGAEITLHRLGIHLKGVVSVETSETNRRVLKRWWYSSGQTGRLEQIEDIRKLTSSTVERLVENFVCFDFVICQNSFTRPSKIPGVGSGLESQHFFDFTLFNEFVRVLQRVRSAIERKR

SEQ ID NO: 110 - protein, 712 aa, Vitis vinifera
MGEIADYSDSKSSSETVGERGTMIKVEPLELNLPTENMCARHIGHNGASSSGSKLRSSFIGMGFLPSLVDKVIEEKGEDDVDLLLETLCANAALQKSISESSDSLDSFLNDEDTNNPPKFSAGFHPKEEPDVSSGVNDDKRATLVMMKFSVDEVEFAMDKLGEGAPVNELVDFIIAAQIAGSSKMDADDPTYGNEERKEDCNNEALFGTMDKTLRLLEMGFSENEISSAIEKFGSEVPISELADSIFAGQIAEKDKHSSATFRLNHSHTGNDYRSFGKGMEDGLKRRSSGTFMVKTEEYSPEAVSQLRAVDIGDDHKGKRPKQESLDDSSAYIGPTWLEGRKGDHKFSSCRMPLPRRDLNQVAGQLNKFGMSSISKPMPCKSLDQLVAKPPYFFYGNVTNVSHDSWNKISQFLYALEPEFVNTQFFSALNRKEGYIHNLPSENRFHILPKPPMTIEEVIPYTKKWWPSWDTRKQLSCISSETSGISQLCDRLGKILVDSRGLLSFEQQRDILHHCRTLNLVWVGQCKLSPIEPEHLERILGYPLNHTRVPEYSLIERLQSLRHCFQIDTLGYHLSVLKSMFPKGLTMLSLFSGIGGAELTLHQLGIHLKGVVSVEISETKRNILKKWWHNTGQTGELVQIDDIQKLASSKLESLIEKFGGFDFVICQNPCTYSSRNSKMVADGDSLTGFDFSLFCEFVRVLHRVRSTMERRR

SEQ ID NO: 111 - protein, 724 aa, Cucumis sativus
MASNKPIVPKEEVFDFRLPPDRMYSRHVGDSGASSSGSNVRTFFIDMGFLPSLVDSVIEKNEQKSIPQSSDSLEGLQSGKMGSNPPHVSTVCHKQVQAAQTSKSESSDSLDSLFDDKDAHNEISSVIPKEEADDYYHISDTNKASLLVMNFSADEVDFAIDKLGGDAPLNELVDFIIAAQIAIKLEKETDDAFCRNELKKEENDETLFVTMEKTLRLLEMGFSENEVSLAIEKFGSETQVSELADSIVTGRIASDYPGDVKCSPSSFGIGGLYTREDYVTKVKAEESSSAVGPLPRNVNIEAIQKGKRPKEENMDDLLNPTTRLNKHKGKRPKQEYADDLGSLYGPGWVESKVNPDITSFDIPPSSRLNLSRSLDKLVAKPPCPPLKSNPSRALEKVVTKPPFFLYGNVLDISRDSWAKVSKFLYAVEPEFVDTRSFSALSRTEGYVHNLPCENRFHIIPLPPMTIQDATRTKKWWPSWDTRKYLSCINSETRGVPQLCDRLTKTLTDSGGHPSSHEERDILHHCIALNLIWVSQFKLAPVEPEQLECVLGYPVNHTQDAESSSIERLQYLKYCFQTDALGYHLSVLKSMFPEGLVVLSIFSGIGGAEIALHRLGIHLKVVVSVESSAAKRRILKKWWHSSGQTGELEQIEDIQKLTSIKINNWITKYGGFDLVICQNPCSRCLSSSKLNQSGDAEGIASFDFSIFYEFVRVLQSVRNTMHRKK

SEQ ID NO: 112 - protein, 743 aa, Arabidopsis lyrata
MVWNLATLGLLLSFCLESLFQFVFFLSGILQGDLRRRNGNGGSSNHERNEQILFPKPETLDYELPCDTSYPHQIGDNAASSSGSNVKSLLIEMGFCPTLVQKAIDENGEDDIEFLLEILTKSTVTEQPGTSFHGLMEPKPEPDIEYETDGRRIALLTMQFPENLVDFALDRLGKDAPIDEMVDFIVAAQLAEKYAEESEDSLDGAEINEEDEDVTPVTARGPEVPNEQLFETMDKTLHLLEMGFSNDEISMAIEKIGTEGQISVLAESIVTGEFPAVCHDDLEDIEKKVSAAAPAANRACLSKSWRFVGVGAQKEDGCGGSSSGTANIKPDPGIDSFPFPATANVGETSKGKRPKDEDENAYPEEYTDHDDRGKRLRPEYMGDSSSFMETPWMQDEWKDNTYEFPSVMQPRLSQSLGPNVAKRPYFFYGQLGELSPSWWSKISGFLFGIHPEHVDTRLCSALHRTEGYLHNLPTVNRFNILPKPRLTIQDAMPQMKSWWPQWDIRKHFNSGTCSNRKDVTLLCERIGRRIAECRGKPTQQDQTLILRHCHTSNLIWIAPNILSPVEPEHLECIMGYPTNHTNIGGGRLAERLKLFDYCFQTDTLGYHFSVLKSMFPEGLTVLSLFSGIGGAEIALDRLGIHLKGVVSVESCGLSRNILKRWWQTSGQTGELVQIEEIKSLTTKKLETLVQRFGGFDFVICQNPSTPLDLSKEISNSEACEFDYTLFNEFARVTKRVRDMMELS

SEQ ID NO: 113 - protein, 626 aa, Arabidopsis thaliana
MVIWNNDDDDFLEIDNFQSSPRSSPIHAMQCRVENLAGVAVTTSSLSSPTETTDLVQMGFSDEVFATLFDMGFPVEMISRAIKETGPNVETSVIIDTISKYSSDCEAGSSKSKAIDHFLAMGFDEEKVVKAIQEHGEDNMEAIANALLSCPEAKKLPAAVEEEDGIDWSSSDDDTNYTDMLNSDDEKDPNSNENGSKIRSLVKMGFSELEASLAVERCGENVDIAELTDFLCAAQMAREFSEFYTEHEEQKPRHNIKKRRFESKGEPRSSVDDEPIRLPNPMIGFGVPNEPGLITHRSLPELARGPPFFYYENVALTPKGVWETISRHLFEIPPEFVDSKYFCVAARKRGYIHNLPINNRFQIQPPPKYTIHDAFPLSKRWWPEWDKRTKLNCILTCTGSAQLTNRIRVALEPYNEEPEPPKHVQRYVIDQCKKWNLVWVGKNKAAPLEPDEMESILGFPKNHTRGGGMSRTERFKSLGNSFQVDTVAYHLSVLKPIFPHGINVLSLFTGIGGGEVALHRLQIKMKLVVSVEISKVNRNILKDFWEQTNQTGELIEFSDIQHLTNDTIEGLMEKYGGFDLVIGGSPCNNLAGGNRVSRVGLEGDQSSLFFEYCRILEVVRARMRGS

SEQ ID NO: 114 - protein, 686 aa, Ricinus communis
MGVIVYCFRITTCKPVYMEHKTLYLEILGIAVASKEMDGDSFCGEGDNFDWDSEDEREIENFGLTNSSCLAVPAVEATARSVEKCLMGFSCILRHASSSVRSSGTKVMDHFVGMGFPEKMVAEAIQENGEENADLILETLLKFSTISSPSSSGSKLIDHFVGMGFDVEMVDRAIQENGEEKTDSILETLLTYSVIEKSHQEQPHVDSDHWSSEYEGSFLNDFSDIDSSENEENGKSQPVEGNTLRFLARMGYTTDEASIALERCGPDANIAELTDFICAAQMAKAADASFPEEKPKIRHFDDDYPKNKKRNYAEYDMWKKKKQMKLDKKLLNGDDELIRLPNPMLGFGVPTDPAIVTHRKLPEAALGPPFFYYENVALAPKGVWQTISRFLYDVEPEFVDSKYFCAAARKRGYVHNLPIQNRYPLLPLPPNNIHEALPLTKRWWPSWDTRTKLNCLQTCVASAKLTDRIRKALEDYEGEPPLSIRKYVLDECRKWNLLWVGRNKLAPLEPDEVEMLLGFPRNHTRGGGISRTDRYKSLGNSFQVDTVAYHLSVLKDMFPEGISLLSLFSGIGGAEVALHRLGIRLKRVVSVEISEVNRNIMRCWWEQTNQTGTLIDIADVHDLNADRLEQLMSSFGGFDLVVGGSPCNNLAGSNRHHRDGLEGKESSLFFDYCRILDLVKCIMTRN

SEQ ID NO: 115 - protein, 590 aa, Glycine max
MGGDDSGLESDNFDWNTEDELEIQNYNSSSSCLTLPNGDAVTGSGEASSSAVLANSKVLDHFVSMGFSREMVSKVIQEYGEENEDKLLEELLTYKALESSSRPQQRIEPDPCSSENAGSSWDDFSDTDIFSDDEEIAKTMSENDDTLRSLVKMGYKQVEALIAIERLGPNASLEELVDFIGVAQMAKAEDALLPPQEKLQYNDYAKSNKRRLYDYEVLGRKKPRGCEKKILNEDDEDAEALHLPNPMIGFGVPTESSFITHRRLPEDAIGPPYFYYENVALAPKGVWQTISRFLYDVEPEFVDSKFFCAAARKRGYIHNLPIQNRFPLLPLPPRTIHEAFPLTKKWWPSWDIRTKLNCLQTCIGSAKLTERIRKAVEIYDEDPPESVQKYVLHQCRKWNLVWVGRNKVAPLEPDEVETLLGFPRNHTRGGGISRTDRYKSLGNSFQVDTVAYHLSVLKEMYPNGINLLSLFSGIGGAEVALHRLGIPLKNVVSVEKSEVNRNIVRSWWEQTNQKGNLYDMDDVRELDGDRLEQLMSTFGGFDLIVGGSPCNNLAGSNRVSRDGLEGKESSLFFDYFRILDLVKNMSAKYR

SEQ ID NO: 116 - protein, 603 aa, Zea mays
MVHWVSDSDGSDNFEWDSDGNGEQTVSFNAAGAGSSALAATNTDAPGPSTRVANGNGKAGRSASLVQKYVDMGFSEEIVLKAMKDNGDNGADSLVELLLTYQELGNDLKVDNDFASSCAPKTADDSDDDDTLEIWDDEDAGGRSTRVANSVDDSDDEDFLHEMSRKDEKVDSLVKMGFPEDEAALAITRCGPDASISVLVDSIYASQTAGDGYCGNLSDYEDNSYGGRSTGNKKKRKRYGGQAQGSRGPLDGSCDEPMPLPHPMVGFNLPDQWSRRVDRSLPAQAIGPPYFYYENVALAPKGVWTTISRFLYDIQPEFVDSKYFCAAARKRGYIHNLPLENRSPLLPIPPKTISEAFPRTKRWWPSWDPRRQFNCLQTCVSSAKLLERIRVALTNSSDPPPPRVQKYVLEECRKWNLAWVGLNKVAPLEPDEMEFLLGFPKDHTRGISRTERYRSLGNSFQVDTVAYHLSVLKDLFPQGMNVLSLFSGIGGAEVALHRLGIRMNTVISVEKSEVNRTILKSWWDQTQTGTLIEITDVQTLSSERIEAYIRRIGGFDLVIGGSPCNNLTGSNRHHRDGLEGEHSALFHHYFRILHAVKSIMERL

SEQ ID NO: 117 - protein, 588 aa, Medicago truncatula
MGDYSGLDSDIDWNTDDELEIESFQPSCSTVVPSGQTITAGSVEPSSFAGPSNTKVFDHFISMGFPGEVVSKVIQEHGEENEEKLLNEILTYSVLESSPQQQQPAELDPTSSECAGSSWEDLSEDDFFSDEELPKFDSTNDDTLTKLVKMGFEEEEALVAIDRIGSDSLEALVDFIGAAQVAKAENALLLPEDKPGCSGNPKLKKRSLYEYEVLGKKRPKLEKRTLCEDEEEAQTLNLPNPMMGFGIPNEPSSMITHRRLPENAVGPPYFYYENVALAPKGVWQTISRFLYDVEPEYVDSKYFCAAARKRGYIHNLPIVNRFPLLPLPPRTIHDAFPLLRRWWPTWDPRTKLNCLQTVHASAKLTDRIRKAVESCDDFEEPSETVKKYVLDQCRKWNLVWVGKNKVAPLEPDEVEMLLGFPRNHTRGGGISRTDRFKSLGNSFQVDTVAYHLSVLKEMYPKGVNLLSLFSGIGGAEVALHRLGIPLRNVVSVEKSEVNRNIVRSWWEQTNQRGNLVDFDDVQQLDADRLERLMGAFGGFDLIVGGSPCNNLAGSNRVSRNGLEGSESILFYEYFRILDLVKVMAPRFR

SEQ ID NO: 118 - protein, 740 aa, Sorghum bicolor
MPVAYHQRPAHCWCCLAGAAREFLVETCLEIRRLPLSSKSGQSRDGGGRQSRPVAGAASCSSSSSATASQLPARRGRRRREGRSGRGSPRRGGADGDGRGEAAEVVRGGAERGCAVPLRPVPQPPEPLREGSGMAHWVSDGDGSDSFEWDSDGNGEEAGSFNTAGASSSAMASTNTDAPGPSRRVSQVANGNGKAGPSASLVQRYIDMGFAEEIVVKAIKDNGDNGADALVELLLTYQELGNDLNVDNGFASGCVPQTVDDSGDDDFLENWDDLDAGGRSTRVANSVDDSGDEDFLHEMSQKDNKIDSLVKMGFPEDEAALAITRCGQDASISVLADSIYASQTAGDGYCGNLSDYEDGGRNKGRFMDGNNKKRKRYGSQALGSRGPLDGSADEPMLLPNPMVGFSLPDQWPRPVNRDLPALAMGPPYFYYENVALAPKGVWTIISRFLYDIQPEFVDSKYFCAAARKRGYIHNLPLENRSPLLPKPPRTITVAFPHTKRWWPSWDPRQQFNCLQTCVSSAKLLEKIRVTLTNSSDPPPPRVQKLVLEECRKWNLAWVGLNKVAPLEPDEMEFLLGFPKDHTRGICRTERFRSLGNSFQVDTVAYHLSVLKDMYPEGMNVLSLFSGIGGAEVALHRLGIRMKTVISVEKSEVNRTILRSWWDQTQTGTLIEINDVQTLTSERIEAYIRRFGGFDLVIGGSPCNNLAGSNRHHRNGLEGEHSSLFFQYVRILESVKSIQRL

SEQ ID NO: 119 - protein, 598 aa, Oryza sativa
MVDWASDSDNDKFEWDTDGEAETSSAPALRNIDAPGPSTRLPQDANGKANGSGALVAEFMGMGFPKEMILKAIKEIGDTDTEQLLELLLTYQAIGGDASVGNCSASACAPQTLEVDEEEDDTNWDEYDTAGNCDRTPHSDGSGDEDFFQEMSEKDEKMKSLVNMGFPEDEAKMAIDRCGLDAPVAVLVDSIYASQEAGNGYSANLSDYEDTEFSSFGGRKKTRFVDGSKKRKRYGSGPSGNQVPFDGSHEEPMPLPNPMVGFSLPNERLRSVHRNLPDQALGPPFFYYENVALAPKGVWTTISRFLYDIQPEFVDSKYFCAAARKRGYIHNLPIENRSPVLPMPPKTISEAFPNTKRWWPSWDPRRQFNCLQTCMASAKLTERIRCALGRFSDVPTPQVQKYVLDECRKWNLVWVGKNKVAPLEPDEMEFLLGYPRNHTRGVSRTERYRALGNSFQVDTVAYHLSVLRDLFPNGMNVLSLFSGIGGAEVALHRLGIHMKTVISVEKSEVNRTILKSWWDQTQTGTLIEIADVRHLTTERIETFIRRFGGFDLVIGGSPCNNLAGSNRHHRDGLEGEHSALFYDYIRILEHVKATMSAV

SEQ ID NO: 120 - protein, 592 aa, Brachypodium distachyon
MPQDCISDSDDSAKFEWESDNEAEPSSAPVLRNFDAPGPSTVWQDANGWANGDAPSTSLVEEYVGMGFPKEMVLKAIKEIGHNDANALLELLLTYKVLGEDPTVGNCSTLGCAPQSVEDDDDGDLDSEDWDDEDDADGGEPNFDSSGDEDFLQEMSEHDKKIKSLVDMGFPEDESNMAIVRCGVDAALTVLVDSIYASQAAGDCNSRNSSHHEVCDSFGGRRNKKKRKQYGGGAQGNRPSECHEELMPLPNPMVGFSLPTARLPSVSRRLPKQATGPPFFYYENVALAPKGVWTIISRNLYDIAPEFVDSKYMCATARKRGYVHNLPIENRSPLLPLPPKTIFEAFPHYKKWWPSWDPRRQLNCVQTCVSSAKLTERIQCALARSGDPPPLHVQKYVMHECRKWNLVWVGKNKVAPLEPDEMEYLLGYPRDHTRGIGKTARYKCLGNSFQVDTVAYHLSVLRDIFPNGLNVLSLFTGIGGGEVALHRLGIHMKTVVSVEISEVNRRILRGWWDQTQTGTLIEIPDVQSFTSDKIRSFIRRFGGFDLIIGGSPCNNLAGSNRHHRDGLEGEHSSLFYHYPRILDTVKDVMAGM

SEQ ID NO: 121 - protein, 634 aa, Populus trichocarpa
MDGDSLCGDNDDFDWDSEDEKEIENFASSSSSSLRLPQVETRSSSAEASSSVGSSSGSKMIDHFVKMGFPEKMVAEAIQENCKGEEDEDSILETLLKYSTSSSASSSGSKLFDRFVGMGFAEKMVAKAIKENGEGDADSVLETLLTYAAIGKSPQEQPNNDSDHCSSGHEGSFLDDFSDVDSADDEVITKTVSDEDNKLAFLRRMGYKEADASIAITRCGTEATISELADFICAAQIAKAEDAFFAEDEKKPKHLDKQKKRSFLESDVLEKKRQKGLENGDDEGVRLPNPMVGFGVPTEPGIVTRRTLSEAAIGPPFFYYENVALAPKGVWQTISRFLYDVEPEFVDSKHFCAAARKRGYVHNLPIHNRFPLLPLPPNTIHEALPLTRKWWPAWDERTKLNCLQTCIASAKLTERIRKALEAYEGEPPLHVQKFIMDECRKWNLVWVGRNKVAPLEADEVEMLLGFPRNHTRGGGISRTDRYKSLGNSFQVDTVAYHLSSLKDLFPGGINVLSLFSGIGGAEVALHRLGIRLKNVVSVEISNVNRSIMSCWWEQTNQTGNLIHIEDVQHLTADRLEQLMNMYGSFDLVVGGSPCNNLAGSNRHHRDGLEGKESSLFFDYCRILDVVKNLTSRYS

SEQ ID NO: 122 - protein, 616 aa, Vitis vinifera
MVDPLYFRSGLGHALDGNISGEESDSIDWNTDDELETQNLPPSSSSTLIIPGGEASIASGEASSSTGPSNSKLINHFMGMGFSEKMVVKAIEQDGEGNTDSILEYLLTYSALENCPQELENSPQAEPQVVSDNCSSDYDESFLDDFSDTDSCHENQENINSLSDKEKKLLFLADMGYTVEEASIAMDRCGPDSSVVELTDFISAAQISKAADADLGELSDEEKPRPKHLYKDYNKQKKRKFLDYRLWERKKQRGYEKKLRNEDDEPIRLPNPMVGFGVPAEPCPVFHRTLPEAAVGPPYFYYENVALAPKGVWSTISRFLYDVEPEFVDSKYFCATARKRGYIHNLPIQNRFPLLPLPPLTIYEALPLTRKWWPSWDTRTKLNCIQTCVGSAKLTDRIRKALEEWDGVPPMSVQKYVLDECRKWNLVWVGRNKLAPLEPDEVEMLLGFPRNHTRGGGISRTDRYKSLGNSFQVDTVAYHFSVLKDMFPGGITLLSLFSGIGGAEIALHRLGIPLKNVVAVEISETNRNILRSWWEQTNQRGTLVDIADVQQLNGDRLEQLIHTFGGFDLIVGGSPCNNLAGSNRVSRDGLEGKESALFYDYFRILDLVKCIMGRNQ

SEQ ID NO: 123 - protein, 586 aa, Cucumis sativus
MAGDDFGVEVDNIDWDTEDELEIENIPLGSHASLAFPGVEANMASSSAGPSNSKTVDYFIGMGFSAKMVAKAIEDNGEENTDSILETLLTLSALENSPPKQQHVDTDDSFSDYEGSFLDDFSDLDSDYENEATAKPVSDADNKMTFLVDMGYSEDEAYAAIERCGVHSSFAELTDFISAAQISKAADVLLGDLPVRPKPKNLNGCSKLNKRRHYDDDTWKKKKPRCFEDEDDDTIRLPNPMIGFGVPNELCLTVHRKIPEAAMGPPYFYYENVALAPKGVWNTISRFLYDVEPEFVDSKYFCAAARKRGYVHNLPIHNRFPLLPLPPHTVHEALPLTRRWWPSWDTRTQLNCLQTCIGSARLTDRIRRALEDYDGVRDPPLHVQKFVVEQCRKWNLVWVGKNKVAPLEPDEVEMLLGFPKNHTRGGGISRTDRYKSLGNSFQVDTVAYHLSVLKDMFPGGINLLSLFSGIGGAEVALHRLGIPLKNVVSVDISEVNRNIVRCWWEQTNQKGTLIDLADVQELDADRLQYYMNLFGGFDLVVGGSPCNNLTGSNRYTRDGLEGKESILFYDYFRILDLVKCIATKTE

SEQ ID NO: 124 - protein, 628 aa, Arabidopsis lyrata
MAQDSAGDDDFVDWNTDDDLEIDNFQSSPPSSPIQSRVETLVGVAVTTSSLSSPTETTDLVQMGFSDEIFATLFDMGFPVEMIARAIKETGPNAETSVIIDTISKYSSNCEAGSSKSKAIDHFLAMGFDEEKVIKAIQEHGEENMEAIANALLSCAEAEKLPVVEEEDVIDWSSDDETNYSDILVSDDEKDPNSKENSNQIRSLVRMGFSELEASLAVERCGENVDIAELTDFLCAAKMAREFSEFHTDPEERKPRNDIKKRRLESKKEPRSSVDDEPVRLPNPMIGFGVPNEPGLITHRSLPELARGPPFFYYENVALTPKGVWETISRHLFDIPPEFVDSKYFCAAARKRGYIHNLPINNRFQIQPPPKYTIHDAFPLSKRWWPDWDKRTKLNCILTCTGSAQLTNRIRLALEPYNGEPEPPKHVQRYVIDQCRRWNLVWVGKNKAAPLEPDEMENILGFPKNHTRGGGMSRTERYKSLGNSFQVDTVAYHLSVLKPIFPHGINVLSLFTGIGGGEVALHRLQIRMKLVVSVEISKVNRNILKDFWEQTNQTGVLIEFSDIQHLTNDTIEGLMEKYGGFDLVIGGSPCNNLAGGNRVSRVGLEGDQSSLFFEYCRILEVVRAMRRS

SEQ ID NO: 125 - protein, 1047 aa, Arabidopsis thaliana
MDSAIEISSGSDSDDEVPPQPVWPQTRTRMDPTWLSRRPLPTVDSHARAEHTNQAPPNGASSDTSRPGVSKPFTGNGNTVNSRISSGSGADYVRLSSEQALKRTLPPSFNSPPLPARSGTNNISNASGSRVGVDYERPLSQQALKRTLPPSFNPPPLPSRSGTNNIRNAGGSRFGADYSHPAVSAVGNKSTFGDHYSGAHAEIGIQRGVNGVRILPPSLTHGTSASVLHHAGSSDPMHRFGGGEDRNPDNDERLVYQAALQVLNQPMTESDLPPGTLSVPLMRHQKIALAWMFQKETSSFNCPGGILADDQGLGKTVSTIALILKQKIVSQLKSESSCKQETEALVLDADDESDNAKHESGSHVKPELKVSSNSETSVLSACGNDENDSSDMEKAEDEEANSSTRAFQWKRPAAGTLIVCPASVVRQWARELDEKVSEESKLSVLVYHGSNRTKDPNELAEYDVVVTTYAIVTNEAPNKFLVDEDENDEKNTDRYGLASGFSNNKKRKVVVGASKKSKRRGRKSTNDTSSEPDCGPLGKVGWFRIVLDEAQTIKNYRTQMARSCCTLRAKRRWCLSGTPIQNTIDDLYSYFRFLRYDPYAVYKSFYSTIKVPISRNSCQGYKKLQAVLRAIMLRRTKGTLLDGKPIINLPPKVVNLSQVDFSVAERSFYKKLEADSRSQFKAYADAGTLSQNYANILLLLLRLRQACDHPQLVKRYNSDPVGKVSEAAVRRLPREARSRLINRLESSSAICYECNEPPEKPVVTLCGHIFCYECVLEYITGDENTCPVPRCKQQLARDVVFSESSLRNCTSDDSGCSSSHDNGLDRSVFQKRDFCSSKIKAVLDILQSLSQPDSPNSAQHGQMPSSSRPYDDDDVTIVEPMRLHSSSPSQGAVKTIIFSQWTGMLDLVELRILESGIEFRRLDGTMSLAARDRAVKEFSKKPDVKVMLMSLKAGNLGLNMVAACHVILLDLWWNPTTEDQAIDRAHRIGQTRPVTVTRITIKDTVEDRILKLQEEKRTMVASAFGEEHGGSSATRLTVDDLKYLFMV

SEQ ID NO: 126 - protein, 993 aa, Ricinus communis
MEPIDISSDSDVVIEDDEDFEFETSPVRRPTDSRILPPWAAIATTDSRSSGYGRQTQRDTSPKRPYSSNGSSSNWHSSNGGSSNWHTSQADDSLYAIGNGNAGLPRTVNSRIANVYGTDYEKLSSQQALKRTLPSSLHRSPISSISNSLVEGVSSSQTRDIYGNAYHPAGPSSSHSKGFGRGNYEEAITYVSNGSRTLPPSLMRGKSTPSAQFGLRDPAFHPMAGEEGVAGSDERLIYQAALEDLNQPKVEATLPDGLLSVPLLRHQKIALAWMLQKETRSLHCLGGILADDQGLGKTVSMIALIQMQKFLQLKSKSEDQANKKSEALNLDDDDESGRPGLNEVKQVGEYDDTTSVPEASNSTRVFKRKRLAAGTLVVCPASILRQWAGELDDKVADEAKLTCLIYHGGSRTKDPAELAKYDVVLTTYSIITNEVPKQPLVNEDEADEKDGEKCGLSSEFSINKKMKKTTTVSKKRKKGRKGIDCSSNDYDSGPLARVGWSRVILDEAQTIKNHRTQVARACCSLRAKTRWCLSGTPIQNAIDDLYSYFRFLRYDPYAVYKSFYTTIKVPISRNAIQGYKKLQAVLRAVMLRRTKGTLIDGEPIVKLPPKSTCLTKVNFSTEERAFYTRLEADSRSKFKAYAAAGTVNQNYANILLMLLRLRQACDHPLLVKGLNSDSFGKDSAEMAKRLPNDMVINLLSCLATSSAICRACNDPPEDPVVTMCDHVFCYQCVSEYLTGDDNMCPARGCKELLGPDVVFSEATLRSCMSDNLDAGPKRPEFDERAMVLQNEYSSSKIRAVLEILQSHCQVKSPSPELGGATEYNGSSTAPSSLVIKSIIFSQWTSMLDLVEFSLNQHCIQYRRLDGTMTLGARDRAVKDFNTDPEVTVMLMSLKAGNLGLNMVAACHVILLDLWWNPTTEDQAVDRAHRIGQTRPVTVTRLTIKDTVEDRILALQEEKRRMVASAFGEDASGGSATRLTVEDLKYLFMGRSAP

SEQ ID NO: 127 - protein, 1027 aa, Glycine max
MDSQNGCIYISSSDDDLEEIEDPRRTLPQWATNTEKSSYNGGWSRRDSSSRGANSSNPSSSNVYNHSQVKPQTLPVSSTNTLNHRIARRDEPSYHALNGNTSQQQTVSSRISNIHGADYEKMSSQQAFKRTLPSSLQPSATRALPSSFASDSRLRNLKDNASSSQLHDAYKNRPHGVGPSTSSDRGYIRENFGRGYDEDRFLYQNGGNRILPSPLMLGKVISPQFATSSESAYRSGAGDERAAESDERLIYEAALQDISQPKTEYDLPAGVLSVSLLRHQKIALAWMLQKETKSLHCLGGILADDQGLGKTISMISLILAQRTLQSKSKIDDTCSHKTEALNLDDDDDNGSVDVEKHKNSEESDDIKPSREPSSSTQAPGRKRPAAGTLVVCPASVLRQWARELDEKVGDEKLSVLVYHGGSRTKDPVELAKFDVVLTTYSIVTNEVPKQPLVEEDDIDEKMGERFGLSSEFSVSKKRKKPFNGNKKSKKGGKGIDSSSIECGSGPLAKVGWFRVILDEAQTIKNHRTQVARACCSLRAKRRWCLSGTPIQNTIDDLYSYFRFLKYDPYAVYKSFYNTIKVPISKNTIQGYKKLQAVLRAIMLRRTKGTLLDGKPIINLPPKTIELSKVDFSIEERAFYTKLESDSRSQFKAYAAAGTVSQNYANILLMLLRLRQACDHPLLVKDFDSDPVGKDSVEMAKNLPREMLINLFNCLESTFAICLVCNDPPEEPVITMCGHVFCYQCVSEYLTGDDNTCPSVNCKELIGDDLVFSKATLRSCISDDGGSVSFANSHLCDYSLVQQRDYTSSKIKAVLEVLQSNCKLKISSSDLPNSSGGCRDSPSLDNLHVEDCDSDVRVTKHTRRYSESTTEGPIKAIVFSQWTSMLDLVETSLKQFGIQYRRLDGRMTLGARDKAVKDFNTEPEITVMLMSLKAGNLGLNMVAACHVILLDLWWNPTTEDQAIDRAHRIGQTRPVTVTRITIKDTVEDRILALQDDKRKMVASAFGEDHAGASGTRLTVDDLKYLFMV

SEQ ID NO: 128 - protein, 1033 aa, Zea mays
MNENSAIIISDSDDDSIGSIFDDDDQPASAIARLDQNAEGRIINFEDEDWQRSAPAPPSTKPTENNNGQYRILPASLTNGRHAESSRYTFGSVDRIHPHANPYMAMRPGHSTSSRIDSVVEKHNSSTADANDNNKRVLPSSFSNGNTSKSMHPIVASETRKLPLPLSTKKSPNIGENRMGTNIANGNLQPSSSIMARGTSSTLNTHKVDDDDDVIVYGGSSSHRVLPSTFEATNSNNSEVAKGFETHSRLNPENRVLDYAERAVYQEALQNISREKSEDDLPEGVLAVPLLRHQKMALAWMVSKENSSHCAGGILADDQGLGKTVSTIALIQKQRMEQSKFMFVDSDRLKSEALNLDEDDEGEQTVSNEPKKDQGACSLSTSAGTSAELFVNQPNNVVNKMVETKAERKKKAKVSTSSASTSRSMTRPAAGTLVVCPASVLKQWSNELTDKVSESAKLSVLVYHGGARTKDPRELAKYDVVVTTYTIVANEVPKQMADDDADQKNSEEPSASNKRKPSANMQNKAKKKKKKLKDSNFDLDSGPIARVRWFRVVLDEAQTIKNFRTVVARACCGLRAKRRWCLSGTPIQNAIDDLFSYFRFLKYDPYCTYNSFCTMIKHPIARDAINGYKKLQAVLKVVLLRRTKETVINGKPIINLPPKTINLNKVDFTQEERSFYLMLEERSRQQFKAFAAAGTLKQNYANILLMLLRLRQACDHPILVKGNQSEYGGDGSIEMAKKLPKEVVIDLLAKLEVGSTLCGLCNDTPEDAIVTICGHVFCYQCIHERITTDENMCPAPNCSRTLGLELLFSSGALKICISGKSSSAVASSSSDNESSSISQSSFVSSKIQAAIDILNSIIVMDPLTESYTMESSRSGLGPVKAIVFSQWTGMLDLLELSLNINCIQYRRLDGTMSLNLREKNVKDFNTDPEVRVMIMSLKAGNLGLNMVSACHVILLDLWWNPYAEDQAVDRAHRIGQTRPVTVSRLTVKDTVEDRILALQEEKRTMVNSAFGDDKAGGHATRLTVEDLRYLFRI

SEQ ID NO: 129 - protein, 1314 aa, Medicago truncatula
MADDGFQFSTLFADDDSDDEKLAMDIESFLSVLDEDCVPSESSPEDSSLKDVSPGESGIHDDFLLQNGNSLLDSEHENQGPSSRTCSSPNVFAGGYRDSFSVAESDETCYAERAGVSEHEMPSYSVGTSSNPSLWKDDDYSQIKHVVDDVESEYASHSSIIENVDGTFEDYGTALKDTIGVSRQPENDSCTSFEMPFVDVDIPTHFGNSADSTFCQGSNVPSDFSGYYSSLNCYQGIDVRPVVTGSSGYFPNGVGSEFWKNEEPVRNMKVEKTEFLTDTTNVIGGMDLSTIGRIPFHDSQFMPVNNEYPSFFPGNAKFEDGESVQQSSCVPYISSEGQSFNVKAEGDEMVMPYQNTFHNDNAGLEVKQLPGIFPTTGYQNYDFFKVEDSNAIVTTEDANYYQDLIGETANKFPGNMGNLNFRSLDKSLSIARASIANGNQYNCSMSELESKPSECKSIDSQLSKRSTEGSNDEDDCDVCIIEDISHPAPTSRSAEFNSLNMSQSSRFDYTQPYMAGGTRPKAHDEQYILRAALQDISQPKSEVTPPDGLLAVPLLRHQECGSDGLDLEFKIALSWMVQKETSSLYCSGGILADDQGLGKTVSTIALILKERPPLLKTCNNAQKSVLQTMDLDDDPLPENGLVKKESTVCQDASDRNATTSANLSVHAKGRPSAGTLVVCPTSVLRQWADELHNKVTCKANLSVLVYHGSSRTKDPYELAKYDVVLTTYSIVSMEVPKQPLVDKDDKDDKEKGIYEDHPVPNRKRKCPPSSKSGKKALNSMMLEAAARPLAKVAWFRVVLDEAQSIKNHRTQVARACWGLRAKRRWCLSGTPIQNAIDDLYSYFRFLRYDPYAVYTSFCSTIKIPINRNPSKGYRKLQAVLKTIMLRRTKGTLLDGEPIISLPPKSVELRKVEFSQEERDFYSKLEADSRAQFQEYADAGTVKQNYVNILLMLLRLRQACDHPLLVKRYNSTTLWKSSVETAMKLPREKQLFLLKCLEASLALCGICNDAPEEAVVSVCGHVFCNQCICEHLTGEDNQCPATNCKTRLNMSAVFPKATLNSSISDPACDHLPGSEVEDSEPCSRTQPCDSSKIRAALEVLQSLSKPQCHTSQRSHVQSTSRESSDCSSTSANNGKSISDVPEKKAMFMEKSSNDSVGSLGEKAIVFSQWTGMLDLLEACLKDSSIQYRRLDGTMSVLARDKAVKDFNTLPEVSVMIMSLKAASLGLNMVAACHVLMLDLWWNPTTEDQAIDRAHRIGQTRPVTVLRLTVKDTVEDRILALQQKKRTMVASAFGEDGTSGRQTRLTVDDLKYLFMM

SEQ ID NO: 130 - protein, 1385 aa, Physcomitrella patens
MEYRLVSSPREPVLTSSSIDITSNVHPITFGSDGQVSVLPTTDSVQQTNDNEIVQRALVKFMQDVRSFVRQGNWKESSTGLFHRSSTDCARDPFQVSVAETIGSLEWGIFGSAGMGESRLRGDYSCSELGQDGMGELEGAQNNWREGEADVEDGSEPVRDETDQRDVYLDELLSVIEDDPDSRVLRIPPGLESRSGESCRSCSYDLEFEVYAPLTILVSPQAAPRFQATSAMDEVLETDGTMPLLGPAVSHQELGIAPYAPAVPEGHYGLSLAPSFNHTTSEVFWQRDLNGSGEGFEETSDEVLSLEDTEQDTIQYFPELTGDLDYDRPQQNDGSVLASNCYSERLSPGVSRPSRSTSSSPIAMFDNTSRHGLVFDSPFERNSIVENPRQFTILNGHAIVDLTSDDSDGDEEESELKEIDGRSRGKRKLPHDETEGDRKRLRETANSSYMQNIGTGFPYTQIAKKPCETISFPNRSQSWSPSSLKYSSQLGNLESSVTTATSLKNIPGYESHKTTSARRDTYTSSLTNMAQRSCSGEVSTSYDRGISRVLPGTVARSMAGLVNGMRVAATIDHRLALAMDPVKRSEELAIQAVVQAFSLGDEKEELTPDEDLLTMTLLKHQRIALAWMVNRESGRHEPCGGILADDQGLGKTISTISLILKNRAPILKSGSTSAQSVQLEGSTVDLDAYEDDEDQLLLKKEFENGQWPASALIENGNQLQQDEPKSSQPSSKGRPAAGTLVVCPTSVLRQWAQEIRDKVSIKADVSVLVYHGSNRIKDPHEIAKFDVVLSTYSIVSMEVPKQALPEEKEVDNRRSAFDYGISQFTKPKKDKPEKVKKAKAKGKGAGADGDSSDSGPLARVAWFRVVLDEAQSIKNYRTQVARAVWGLRAKRRWCLSGTPIQNSVDDLFSYFRFLRYSPWGDVYKKFQRDIKDPVGRNPTEGYKKLQAILKPIVLRRTKTSFLDGKPIVNLPQRIVKLQQTEFSLNERSFYSNLETESRAQFQMYAAAGTVQNNYVNILWMLLRLRQACDHPMLVKKCAKSEALQKTTLEAVRKLPPHQRAALIQCLEGGRAICYICQDAPEDPVVSICAHVFCRQCVSEQMNGDDTTCRFPKCKKSLNVSLLYTLSALKDSGVCEESSSLIKEEKSSEPAITELDQSWKTSSKIDAMMNTLQALPKVIVLVEDGKIVKGPKAETLLKAEAVEIDQGETLSSGLPVVSETTVSKIDKVESTEKAIVFSQWTSMLDLLETPLKKSGLCYRRLDGTMSVVARDRAVSDFNTLPEVTVMIMSLKAASLGLNMVAANHVLLLDVWWNPTTEDQAIDRAHRIGQTRTVNVSRFTIKNTIEDRILALQERKRQIVASAFGENSGGEQKNRLTVEDLRYLFRV

SEQ ID NO: 131 - protein, 1255 aa, Sorghum bicolor
MAEEPAVGYDGFEAAGDAGAGGAEDNLSMPLGDFMAFLETEPAPPEEGGEEEEEQEQLQPGVNQGCFEMPANTDGSEDLLQSHEEMFENADLWSNYSHVDTSECHMELSGGEQMIDHTEASPYEFFSNDLQNQSRTSNLDNEHFPRDASNHANVEEVAGPPYEDLSNGLYLRQQTLYSGQTQFQVENNTEGMETQMNTYFSGGISTEHSDLMLGSTGQDGDHFTSMGMFSLTHKTDVPDISCTEFNMGEGTESIRNGNSSCLTMQEAECGGYPHPDCISVDMVDERSLHDLPHGFSQNNEQYEMEQFPQSICESGSMQMGSPDQYCDDTSLSDFYMDVSSPESISCEQNQSEDICFKSESSTDSSPIPSSRNSTTEDADKYLGQTSKQLLDSKIVPFSNQHTFKNMGYQKPLALHKQYAYRSDNSSIHNSSRGCFNRDGDGASDLCVLEGNRNPAPDHRLPYQGKFHHNFQQHMYSNSMIPAFGGMRYKPHDERITLRLALQDISQPKSEANPPDGVLAVPLLRHQKIALSWMVQKETSSSHCSGGILADDQGLGKTVSAISLILTERSPVPQSSTIKNEPCEAVTLDDDDEDDSVEPHPKKLMQTCSSKVTTNTVKQENPFVAIKTRPAAGTLVVCPTSVLRQWAGELKNKVTSKANLSFLIYHGSNRTKDPNELTKYDVVLTTYSIVSMEVPKQSNPDSDDEEKGKPDRYGAPVSSSGSKKRKAPSKKTKCKSAAESCLPEKPLAKVAWFRVILDEAQSIKNYRTQVARACWGLRAKRRWCLSGTPIQNAVEDLYSYFRFLRYDPYAVYKQFCTMIKIPISRNPTNGYKKLQVVLKTVMLRRTKATMLDGKPIISLPPKTVSLKTVDFTGEERAFYNTLEVESREQFKEYAAAGTVKQNYVNILLMLLRLRQACDHPHLVRGYNSSSSWMSSLEMAKKLPMERQHELLNCLQSCSALCALCNDAPEDPVVTICGHVFCNQCILEQLTGDDSVCPVSNCRVRLNTTSLFSRGTLECSLSRLTCDFKSDDDTCMEMIHAEKRPGIDSSYASSKVRAALDILLSLPRIDPTQMTDSKCSIGLESEKFDGRGTSEQIDTKLTEKAIVFSQWTRMLDLLEVHLKASHVTYRRLDGTMSVAARDKAVKDFNTVPEVTVMIMSLKAASLGLNMVAACHVLMLDLWWNPTTEDQAVDRAHRIGQTRPVTVSRLTIKDTVEDRILALQEKKREMVASAFGEDKSGSRQTRLTVEDLNYLFMV

SEQ ID NO: 132 - protein, 1030 aa, Oryza sativa
MLAGNMNNDNYIDLSSDSDIDFDFDSDDSVGGLDQELASSSSRPTENINGQYRTLPPSFTNGRHVDNARHALGSGDRAYPHSSSYRGSPNDSARATPASNRTDIVVKKHNGFASEENDNGKRILPSSFSNGRTTNAMHPVVASETRKFPPSFTNGNSQRLAENRMGKNVANGIGEPSSSRFPSRSSFGTDNKKVITDSDNEDVYVYGSSSSHRVLPPSFGRNSSANHSEFANGIDMQGRLNLENRIIDSDERAVYQEALQNIIQDKREDDLPEGVLSVPLLRHQKMALAWMVSKENSSHCAGGILADDQGLGKTVSTIALIQKQRIQQSKFMSVDSDRLKAEALNLDDDDEAAPVADNKGEQTKNDEPRKDLGAGSSSTAAGTGDVETCASLMNTAPDKTVERNVERKKKSKASTSSTMQSMTRPAAGTLVVCPASVLKQWANELTDKVGESAKLSVLVYHGGSRTKDPNELAKYDVVITTYTIVANEVPKQNADDDTDQKNGEESSAGNKRKQPPKAQSKSKKKKKKLKDSDIYLASGPVARVRWFRVVLDEAQTIKNFRTQVAKACCGLRAKRRWCLSGTPIQNAIDELYSYFHFLKYDPYSTYNSFCTMIKHPIARNAVHGYKKLQTVLRIVLLRRTKETLIDGEPIIKLPPKTINLDKVDFTKEERAFYLTLEERSRQQFKAYAAAGTLKQNYANILLMLLRLRQACDHPLLVKGHQSEYKGDGSIEMAKQLPKEMIINLLAKLEVGEFCSVCSDVPEDAVVTMCGHVFCYQCIYERITTDENMCPSPNCGNTLSTDSVFSSGALRICMSGVSSSHASGSSSLDDESSSISQTSYISSKIQAAIDILNSIINTYALTDSDTVESNPSRVAPVKAIVFSQWTGMLDLLELSLNSNLIQYRRLDGTMSLNSRDKAVKDFNTDPEVRVMIMSLKAGNLGLNMVAACHVILLDLWWNPYAEDQAIDRAHRIGQTRPVTVSRLTIKDTVEDRILALQEEKRAMVSSAFGEDKSGGHATRLTVDDLKYLFRF

SEQ ID NO: 133 - protein, 1070 aa, Brachypodium distachyon
MLASNMNNDNDNVIDLISDSDDDFDFDSDDPTSTSVTSVRNGEGQPIRLQDEDLARTMLSTPSSSRPLKNSNGQYRTLPPSFANGIEPLKNSNGQYRTLPPSFANGIDIKKARYTRGSGDRTYPHSSSYVGSPYDSARATLTSNRIASVVKELNGSALDANDNDKMILPSSFSNGSTAKSINPNVASDSRRLPSRFANGNSQKMVENMMESNDAKQIGQPSSSKFPTQNLSLSNAQKVITDDDDDDDIYVYGGTSSNRVLPSSFGGNNSANNTDLVNGNGMQARPNLESRFLDSEERAVYQEALQNISLDKKEDDLPEGYLSVSLLKHQKMALAWMVSKENSSHCAGGILADDQGLGKTVSTIALIQKQRIPQSKFMSADSDALKSEALNLDEDDETVTVVDKGEQILNNEPKELGASLSSTAASISGVKPCISEIEVPDRMAESKVECKKKTKTGTSSASSMHSMTRPAAGTLVVCPASVLKQWANELTDKVGESAKLSVLVYHGGARTKNPSELAKYDVVVTTYTIVANEVPKQNADDDPDQKNAEESSAGNKTKPSSKSKKRKKKLKDSDIDLNSGPVARVRWFRVVLDEAQTIKNFRTQVAKACCGLRAKRRWCLSGTPIQNAIDELYSYFRFLKYDPYSTYSSFCTMIKHPIARDAVHGYKKLQTVLRIVLLRRTKETKINGEPIINLPPKTINLNKVDFTKEERAFYSTLEERSQQQFKEYAAAGTLNQNYANILLLLLRLRQACDHPLLVKGHQSVFKGDGSIERARQLPKDLVIDLLAKLEVSSLCAVCRDTPEDAVVAMCGHIFCYQCIHERITTDENMCPTPNCRTTLSTESVFSSGTLRICIAGNTCTYATASSSADDELSSISQSSYMSSKIRATVDELNTIINTHAITDSDTSESNPSQVAPVKAIVFSQWTGMLDQLELSLNNNLIRYRRLDGTMSLNLRDRAVKDFNTDPEVRVMIMSLKAGNLGLNMVAACHVILLDVWWNPYAEDQAIDRAHRIGQTRAVTVSRLTIKDTVEDRILALQEEKRAMVNSAFGEDKSGGHATRLTVEDLRYLFRI

SEQ ID NO: 134 - protein, 1327 aa, Populus trichocarpa
MIMADGRSGSVMPGGEIMAVGDGNSGDGEEEDLSMDVDLFYTILGEEPSPASPKIEGADGLGGESMDHAAYSLHNPEGSDARAGHLGGSIDYTGRQMSSLMHARSGSSREFCFPFQKDQGTMRAGASQSEIASCITEPTTFADGVSSCVADHAGSSHGPRMDGLDEKFGSRDALDNDSLGILELKTDIHRSMVMPLMDTDHDMISTKSADWHYPGFNSELRDHDSAMQFGMNGYDAHYTDSSGFDFSSDFNFGLFPINQEINEFQPENACSGPEISMMPCSDVNGMNFKSEGDGYTFPKTRKFSSSADDGLNHDKASVMPPSDIQLGISEVQTVCVEDEKTDGLVACRNMTWQTGEGVTEAVDRKCSWSDGNGTFVYKDKQQSPSGVLSSVQSQKHVIYTNDDRGGMALGSSRAQVEGIAGRFPFDSVYLNLSASEQYLPFAPTSHLSKMQLGCGKDEKQGLPIHSKALGSHLSIVSPESIQSNSSGSKSHVDDEPDICILDDISQPARSNQCFAPSKPIVPLLHPTYNDSLHHSTVEGTRFKANDEQLVLRVALQDLAQPKSEAVPPDGFLAVPLLRHQRIALSWMVQKETSSLHCSGGILADDQGLGKTVSTIALILKERAPLCRVDAVAVKKEECETLNLDDDDDGVIEIDRLKKGADGSQVKSNRSSTKSLNSPGQSKGRPAAGTLIVCPTSVLRQWADELHTKVTTEANLSVLVYHGSNRTKDPSEVAKYDVVVTTYSIVSMEVPKQPLADEDEEKQRMEGDDVPHLGLSYGKKRKYPPTSGKKGLKNKKGMDSAMLESIARPLAKVAWFRVVLDEAQSIKNHRTQVARACWGLRAKRRWCLSGTPIQNAIDDLYSYFRFLRYEPYAVYKLFCSAIKVPIQKNPAKGYRKLQAVLKTVMLRRTKGTLLDGEPIINLPPKVVELKKVDFTEEERDFYTRLEIDSRAQFKEYAAAGTVKQNYVNILLMLLRLRQACDHPLLVKGLDSNSLGGSSIEMAKKLPQEKQLCLLKCLEASLAICGICSDPPEDAVVSVCGHVFCKQCICEHLTGDDNQCPVSNCKVRLNVSSVFSKATLNSSLSDEPDQDSSGSELVAAVSSSSDNRPHNSSKIRATLEVLQSLTKPKDCLSKCNLSENSADGNVACHETSSGSTGSLNDGTDKRHPPAKVVGEKAIVFSQWTGMLDLLEACLKSSSIQYRRLDGTMSVVARDKAVKDFNTLPEVSVMIMSLKAASLGLNMVAACHVLLLDLWWNPTTEDQAIDRAHRIGQTRKVTVLRLTVKNTVEDRILALQQKKREMVASAFGEDENGGRQTRLTVDDLNYLFMV

SEQ ID NO: 135 - protein, 1013 aa, Vitis vinifera
MDPIDITSSSDSDFDFEDDRETDTSPVGESVAFANSRILPPWPSTSGTNSKSTSHGHFQKVPSPKRASASNGSSSNFYHYPPKIQMHPSFDDDIRASNRHNFREADFNYSTENGDMLDVENHQQLINLNKADIFGADYEKLSQPAMRRTLPSTLQPSAPSAGMNNTVGNIGSSHIHDSQGKSFHPVGPILNNMNYMKEHFGRGNDDEVIMYENSGSRILPPSLMHGKSVPSTQYGGVSESAYRPGVAEEMAANTDERLVYQAALQDLNQPKVEATLPDGLLTVSLLRHQKIALAWMHQKETRSLHCLGGILADDQGLGKTVSMIALIQMQKSLQSKSKSEELHNHSTEALNLDDDDDNANAAGSDKGKQTEETSDSKPISEVSASLPEFRRRRPAAGTLVVCPASVLRQWARELDEKVSEEAKLSVCLYHGGSRTKDPVELAKYDVVLTTYSIVTNEVPKQPLVDDDEGDERNGEKYGLSSEFSVNKKRKKPSNVSKRGKKGRKGIDSSSIDYDCGPLARVGWFRVILDEAQTIKNHRTQVARACCSLRAKRRWCLSGTPIQNAIDDLYSYFRFLKYDPYAVYKSFYNTIKVPISRNSVHGYKKLQAVLRAIMLRRTKGTLIDGTPIINLPPKTICLSKVDFSSEERAFYSKLEADSRSQFKEYAAAGTVNQNYANILLMLLRLRQACDHPLLVKGYNTDSIRKVSSEMAKKLPSDILINLLDILETSAICRVCNDPPEDAVVTMCGHVFCYQCVSEYLTGDDNTCPALECKEQLGADVVFSKATLISCISDELDGSLSNSSQSAEKSINLQNEYSSSKIRAALEILQSHCKLTSPDSDPHSSMGCNGSYSNPETEGPIKAIVFSQWTSMLDLVEMSMNHSCIQYRRLDGTMSLASRDRAVKDFNTDPEVTVMLMSLKAGNLGLNMVAASLVILLDLWWNPTTEDQAVDRAHRIGQTRPVTVSRITIKDTVEDRILALQEDKRKMVASAFGEDQTGGSATRLTVEDLKYLFMV

SEQ ID NO: 136 - protein, 1286 aa, Cucumis sativus
MVISDDLINQSPLLSIAGEVLGFQTFLIRFCFQTSLFAGLCVFSGFSLMIILMADEASNFPLQYADDDFDEDMSMEYEKILHLLSEDLDPLQIKTEDLSPNNASTGQPAFDSSNQENFQLQNDISHGFMDVTLKNHDSLDGKGTETLRSSENNSCASVELPSFDAEHSSKEVFPTESTVNPSFDFVTDVTNSYSTMPYWMSTVEQPFLVSSQYLFPGDYDSPLVSGNGDMTVNMMHDVEFPSNSLCSSTTMDLYAQGATDHKSVSRESVSKDLILDRYSNVKRWDQNCESGNFISSFDGKYPFHVDNLHIGQASMGIPMSTELNSSCKELVSQMKNETMDSLVESCSGPWQSMMEENLFFQSQRVFRSEDMVCGTSGRLSNDGRYQNLYITDQYSPNGHSSNLSNQPLVFIKDDRDHKLSVRKSDIDHPQVSPESTHSNLSDRAHVEDDPDICIIEDMSHPAPSNRSLMVGKSVASQSFSIVSGSSTYMGIGSLRQKAKDIDILKVALQDLSQPKSETSPPDGALDVPLLRHQRIALSWMVQKETSSVPCAGGILADDQGLGKTISTIALILKERAPIRACPTVKHEELETLNLDEDDDIHPEHDGPKQEFSHQVSPSKDLTLSKNTSVQAKGRPAAGTLVVCPTSVLRQWADELHNKVSSKANLSVLVYHGSSRTKDPCELAKYDVVLTTYSIVSMEVPKQSVVDEEDDEKHNTEEQAILPSHLSSSKKRKNFSGSDKKHSKNKKGVDNEVFESVARPLAKVRWFRVVLDEAQSIKNHKTQVARACWGLRAKRRWCLSGTPIQNAIDDLYSYFRFLKYDPYAAYKSFCSAIKFPINKNPAKGYKKLQAILRTIMLRRTKATLLDGQPIVTLPPKHVELKKVDFTEEERDFYSKLEADSRAQYEEYAAAGTVKQNYVNILLMLLRLRQACDHPLLVKPYDSKSLWRSSADVAKKLPRDKQIFLLNCLEASLAICGICNDPPEDGVVSECGHVFCKQCILEHLSSDDCQCPTGGCKVHLNASLLFSKSSLCNSNSDQLGEDNSVVSSCSTVGDSMELSSSVMYESSKIKAALEVLMSLAKPKEYSRNTSPELAVVGASEKSMDASSTELRLESSECQDSTNKSSCELVKRGGEKAIVFSQWTGMLDLLEACLKNSSIQYRRLDGTMSVLARDKAVKDFNNLPEVSVMIMSLKAASLGLNMIVACHVLLLDLWWNPTTEDQAIDRAHRIGQTRPVTVLRLTVRDTVEDRILALQQKKREMVSSAFGEDEAGGRQTRLTVEDLNYLFMM

SEQ ID NO: 137 - protein, 1046 aa, Arabidopsis lyrata
MDSAIEISSGSDSDDELPQPIRPQIRTRTDPIWLGIEIVPTVDSHARAEHTNQASRNSASNDTSRPGVSKPFTGNGNTVNSRISSGSGADYERLSSEQAPKRTLPPSFSSPPFPSRSGANNISNASGSRVGADHERLSSQQAPKRTLPPSFNPPPLPSRSGTNNISNASGSRFGADYSRPAVSAVGNKSTFGDHYSGAHAEIGIQRGMNGVRILPPSLTHGTSASVLHHAGSSDPMHRLGTGEDRNPDNDERLVYQAALQDLNQPITESDLPPGVLSVPLMRHQKIALAWMFQKETRSFNCAGGILADDQGLGKTVSTIALILKQKIVSQLKSANSCKQETEALVLDADDESDNAKHENGSHVKPELKVSSNSETSVLSASGNDENDSSDMEKAKDEEANSSTRAFKWKRPAAGTLIVCPASVVRQWARELDEKVSEEWKLSVLVYHGSNRTKDPNELAEYDVVVTTYAIVTNEAPKKFLVDEDENDEKSTDEYGLASGFSNNKKRKVAVGASKKSKKRSRKSTDNSSSEPDCGALGKVGWFRIVLDEAQTIKNHRTQVARSCSTLRAKRRWCLSGTPIQNTIDDLYSYFRFLRYDPYAAYKSFYSTIKVPISRNSCQGYKKLQAVLRAIMLRRTKGTLLDGKPIINLPPKKVNLSTVDFSVEERSFYRKLEADSRSQFKAYADAGTLSQNYANILLMLLRLRQACDHPQLVKVYNSDPVGKESEAAVRRLPREARSRLINRLESSSAICYECNEPPEKPVVTLCGHVFCYECVLEYITGDENMCPVPRCKQQLARDVVFSESSLRNCISDDLGCSSSHDKGLDRSVFEKREFCSSKIKAVLDILQSLSKQDTPNSAQHGQMPSSSGPYDDDDVTIVEPMRLHSSSPSQGAVKTIIFSQWTGMLDLVELRILESGIEFRRLDGTMSLAARDRAVKEFSKNPDVKVMLMSLKAGNLGLNMVAACHVILLDLWWNPTTEDQAIDRAHRIGQTRPVTVTRITIKDTVEDRILTLQEDKRTMVASAFGEEHGGSSATRLTVDDLKYLFML

SEQ ID NO: 138 - protein, 630 aa, Artificial Sequence
  Synthetic Construct
LTPEQVVAIASNNGGKQALETVQRLLPVLCQAHGLTPEQVVAIASNHGGKQALETVQRLLPVLCQAHGLTPEQVVAIASNHGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNGGRPALE

SEQ ID NO: 139 - protein, 631 aa, Artificial Sequence
  Synthetic Construct
LTPEQVVAIASNNGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGKQALETVQRLLPVLCQAHGLTPEQVVAIASNGGGKQALETVQRLLPVLCQAHGLTPEQVVAIASNHGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNHGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGRPALE

SEQ ID NO: 140 - protein, 629 aa, Artificial Sequence
  Synthetic Construct
LTPEQVVAIASNGGGKQALETVQRLLPVLCQAHGLTPEQVVAIASNGGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNHGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNGGKQALETVQRLLPVLCQAHGLTPEQVVAIASNHGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGRPALE

SEQ ID NO: 141 - DNA, 18 bp, Artificial Sequence
  Synthetic Construct
cggaaagatgtatgggct

SEQ ID NO: 142 - DNA, 35 bp, Artificial Sequence
  Synthetic Construct
gggagagtgaacgttggtgacctgcttctatgttt

SEQ ID NO: 143 - DNA, 35 bp, Artificial Sequence
  Synthetic Construct
aaacatagaagcaggtcaccaacgttcactctccc

SEQ ID NO: 144 - DNA, 52 bp, Artificial Sequence
  Synthetic Construct
ccaaggacctctcgagggatcttcaggttcatcttcgcggacccggctccct

SEQ ID NO: 145 - DNA, 49 bp, Artificial Sequence
  Synthetic Construct
catagatccctcgagtgaagaaccagatgatccgctagctgacgcgcga

SEQ ID NO: 146 - DNA, 19 bp, Artificial Sequence
  Synthetic Construct
ttaggatttgcgtgtcgac

SEQ ID NO: 147 - DNA, 30 bp, Artificial Sequence
  Synthetic Construct
gtggcaattgcgagcaacgggggaaagcag

SEQ ID NO: 148 - DNA, 30 bp, Artificial Sequence
  Synthetic Construct
ctgctttcccccgttgctcgcaattgccac

SEQ ID NO: 149 - DNA, 35 bp, Artificial Sequence
  Synthetic Construct
ggcaattgcgagcaaccatgggggaaagcaggcac

SEQ ID NO: 150 - DNA, 35 bp, Artificial Sequence
  Synthetic Construct
gtgcctgctttcccccatggttgctcgcaattgcc

SEQ ID NO: 151 - DNA, 28 bp, Artificial Sequence
  Synthetic Construct
tggctattgcatccaacgggggcagacc

SEQ ID NO: 152 - DNA, 28 bp, Artificial Sequence
  Synthetic Construct
ggtctgcccccgttggatgcaatagcca

SEQ ID NO: 153 - DNA, 20 bp, Artificial Sequence
  Synthetic Construct
agcacggatcgaatcacata

SEQ ID NO: 154 - DNA, 20 bp, Artificial Sequence
  Synthetic Construct
ctcgctgcttctcgaatctt

SEQ ID NO: 155 - DNA, 20 bp, Artificial Sequence
  Synthetic Construct
cgggtccttggactcctgat

SEQ ID NO: 156 - DNA, 23 bp, Artificial Sequence
  Synthetic Construct
tcgtgaccggaataattaaatgg

SEQ ID NO: 157 - DNA, 22 bp, Artificial Sequence
  Synthetic Construct
ggcttcgataggaagaatgccc

SEQ ID NO: 158 - DNA, 23 bp, Artificial Sequence
  Synthetic Construct
gtgaaactgccagatccaaattc

SEQ ID NO: 159 - DNA, 29 bp, Artificial Sequence
  Synthetic Construct
tcccgagaagagtagaacaaatgctaaaa

SEQ ID NO: 160 - DNA, 26 bp, Artificial Sequence
  Synthetic Construct
ctgaggtattccatagcccctgatcc

SEQ ID NO: 161 - DNA, 19 bp, Artificial Sequence
  Synthetic Construct
tggaatctcagggtcaagg

SEQ ID NO: 162 - DNA, 19 bp, Artificial Sequence
  Synthetic Construct
ccttctgaggtgagggaca

SEQ ID NO: 163 - DNA, 19 bp, Artificial Sequence
  Synthetic Construct
aagagttatgggccgaagc

SEQ ID NO: 164 - DNA, 21 bp, Artificial Sequence
  Synthetic Construct
cgctcgtatgaatgttgaatg

SEQ ID NO: 165 - DNA, 19 bp, Artificial Sequence
  Synthetic Construct
ataaagagcggcgcaagat

SEQ ID NO: 166 - DNA, 20 bp, Artificial Sequence
  Synthetic Construct
cgctctagggtttttgcttt

SEQ ID NO: 167 - DNA, 20 bp, Artificial Sequence
  Synthetic Construct
aggccccatctcacaaatac

SEQ ID NO: 168 - DNA, 35 bp, Artificial Sequence
  Synthetic Construct
tcgttgtctcgccgaaattcgaaagaccgagagag

SEQ ID NO: 169 - DNA, 47 bp, Artificial Sequence
  Synthetic Construct
cctttaatttccttttttgtttgcgtctctactctctacaatctata

SEQ ID NO: 170 - DNA, 35 bp, Artificial Sequence; identical to SEQ ID NO: 142
  Synthetic Construct

SEQ ID NO: 171 - DNA, 35 bp, Artificial Sequence; identical to SEQ ID NO: 143
  Synthetic Construct

SEQ ID NO: 172 - DNA, 50 bp, Artificial Sequence
  Synthetic Construct
ggtatcccatctcgagtgaagaaccagatgatccgctagctgacgcgcga

SEQ ID NO: 173 - DNA, 19 bp, Artificial Sequence
  Synthetic Construct
ggggatttgataatgcgtc

SEQ ID NO: 174 - DNA, 19 bp, Artificial Sequence
  Synthetic Construct
gttaagactgtgaaagaga

SEQ ID NO: 175 - DNA, 43 bp, Artificial Sequence
  Synthetic Construct
tcatcatagtgttgttatatctttggtgtctctgtcttgcttc

SEQ ID NO: 176 - protein, 134 aa, Picea sitchensis
AEMEFEAKSSRDGAWYDVASFVTHRMFESGDPEVRVRFAGFGAEEDEWVNVRKCVRQRSLPCESSECVAVLPGDLILCFQEGKEQALYFDAHILDAQRRRHDVRGCRCRFLVRYDNDQSEEIVPLRKICRRPET

SEQ ID NO: 177 - protein, 149 aa, Homo sapiens
VNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGE

SEQ ID NO: 178 - protein, 499 aa, Arabidopsis thaliana
LPSCSSSGDSARYKVKETMRLFHETCKKIMQEEEARPRKRDGGNFKVVCEASKILKSKGKNLYSGTQIIGTVPGVEVGDEFQYRMELNLLGIHRPSQSGIDYMKDDGGELVATSIVSSGGYNDVLDNSDVLIYTGQGGNVGKKKNNEPPKDQQLVTGNLALKNSINKKNPVRVIRGIKNTTLQSSVVAKNYVYDGLYLVEEYWEETGSHGKLVFKFKLRRIPGQPELPWKEVAKSKKSEFRDGLCNVDITEGKETLPICAVNNLDDEKPPPFIYTAKMIYPDWCRPIPPKSCGCTNGCSKSKNCACIVKNGGKIPYYDGAIVEIKPLVYECGPHCKCPPSCNMRVSQHGIKIKLEIFKTESRGWGVRSLESIPIGSFICEYAGELLEDKQAESLTGKDEYLFDLGDEDDPFTINAAQKGNIGRFINHSCSPNLYAQDVLYDHEEIRIPHIMFFALDNIPPLQELSYDYNYKIDQVYDSNGNIKKKFCYCGSAECSGRLY

SEQ ID NO: 179 - protein, 532 aa, Arabidopsis thaliana
TSSGSSSGDSSRNKVKETLRLFHGVCRKILQEDEAKPEDQRRKGKGLRIDFEASTILKRNGKFLNSGVHILGEVPGVEVGDEFQYRMELNILGIHKPSQAGIDYMKYGKAKVATSIVASGGYDDHLDNSDVLTYTGQGGNVMQVKKKGEELKEPEDQKLITGNLALATSIEKQTPVRVIRGKHKSTHDKSKGGNYVYDGLYLVEKYWQQVGSHGMNVFKFQLRRIPGQPELSWVEVKKSKSKYREGLCKLDISEGKEQSPISAVNEIDDEKPPLFTYTVKLIYPDWCRPVPPKSCCCTTRCTEAEARVCACVEKNGGEIPYNFDGAIVGAKPTIYECGPLCKCPSSCYLRVTQHGIKLPLEIFKTKSRGWGVRCLKSIPIGSFICEYVGELLEDSEAERRIGNDEYLFDIGNRYDNSLAQGMSELMLGTQAGRSMAEGDESSGFTIDAASKGNVGRFINHSCSPNLYAQNVLYDHEDSRIPHVMFFAQDNIPPLQELCYDYNYALDQVRDSKGNIKQKPCFCGAAVCRRRLY

SEQ ID NO: 180 - protein, 534 aa, Arabidopsis thaliana
SLNGKDVNLEPHLKVTKCLRLFNKQYLLCVQAKLSRPDLKGVTEMIKAKAILYPRKIIGDLPGIDVGHRFFSRAEMCAVGFHNHWLNGIDYMSMEYEKEYSNYKLPLAVSIVMSGQYEDDLDNADTVTYTGQGGHNLTGNKRQIKDQLLERGNLALKHCCEYNVPVRVTRGHNCKSSYTKRVYTYDGLYKVEKFWAQKGVSGFTVYKYRLKRLEGQPELTTDQVNFVAGRIPTSTSEIEGLVCEDISGGLEFKGIPATNRVDDSPVSPTSGFTYIKSLIIEPNVIIPKSSTGCNCRGSCTDSKKCACAKLNGGNFPYVDLNDGRLIESRDVVFECGPHCGCGPKCVNRTSQKRLRFNLEVFRSAKKGWAVRSWEYIPAGSPVCEYIGVVRRTADVDTISDNEYIFEIDCQQTMQGLGGRQRRLRDVAVPMNNGVSQSSEDENAPEFCIDAGSTGNFARFINHSCEPNLFVQCVLSSHQDIRLARVVLFAADNISPMQELTYDYGYALDSVHGPDGKVKQLACYCGALNCRKRLY

SEQ ID NO: 181 - protein, 527 aa, Arabidopsis thaliana
GINVADRENGNRELVLSVLMRFDALRRRFAQLEDAKEAVSGIIKRPDLKSGSTCMGRGVRTNTKKRPGIVPGVEIGDVFFFRFEMCLVGLHSPSMAGIDYLVVKGETEEEPIATSIVSSGYYDNDEGNPDVLIYTGQGGNADKDKQSSDQKLERGNLALEKSLRRDSAVRVIRGLKEASHNAKIYIYDGLYEIKESWVEKGKSGHNTFKYKLVRAPGQPPAFASWTAIQKWKTGVPSRQGLILPDMTSGVESIPVSLVNEVDTDNGPAYFTYSTTVKYSESFKLMQPSFGCDCANLCKPGNLDCHCIRKNGGDFPYTGNGILVSRKPMIYECSPSCPCSTCKNKVTQMGVKVRLEVFKTANRGWGLRSWDAIRAGSFICIYVGEAKDKSKVQQTMANDDYTFDTTNVYNPFKWNYEPGLADEDACEEMSEESEIPLPLIISAKNVGNVARFMNHSCSPNVFWQPVSYENNSQLFVHVAFFAISHIPPMTELTYDYGVSRPSGTQNGNPLYGKRKCFCGSAYCRGSFG

SEQ ID NO: 182 - protein, 521 aa, Arabidopsis thaliana
GISAAEREDGNAYLVSSVLMRFDAVRRRLSQVEFTKSATSKAAGTLMSNGVRTNMKKRVGTVPGIEVGDIFFSRIEMCLVGLHMQTMAGIDYIISKAGSDEESLATSIVSSGRYEGEAQDPESLIYSGQGGNADKNRQASDQKLERGNLALENSLRKGNGVRVVRGEEDAASKTGKIYIYDGLYSISESWVEKGKSGCNTFKYKLVRQPGQPPAFGFWKSVQKWKEGLTTRPGLILPDLTSGAESKPVSLVNDVDEDKGPAYFTYTSSLKYSETFKLTQPVIGCSCSGSCSPGNHNCSCIRKNDGDLPYLNGVILVSRRPVIYECGPTCPCHASCKNRVIQTGLKSRLEVFKTRNRGWGLRSWDSLRAGSFICEYAGEVKDNGNLRGNQEEDAYVFDTSRVFNSFKWNYEPELVDEDPSTEVPEEFNLPSPLLISAKKFGNVARFMNHSCSPNVFWQPVIREGNGESVIHIAFFAMRHIPPMAELTYDYGISPTSEARDESLLHGQRTCLCGSEQCRGSFG

SEQ ID NO: 183 - protein, 526 aa, Arabidopsis thaliana
EITEAETETGNQEIVDSVMMRFDAVRRRLCQINHPEDILTTASGNCTKMGVKTNTRRRIGAVPGIHVGDIFYYWGEMCLVGLHKSNYGGIDFFTAAESAVEGHAAMCVVTAGQYDGETEGLDTLIYSGQGGTDVYGNARDQEMKGGNLALEASVSKGNDVRVVRGVIHPHENNQKIYIYDGMYLVSKFWTVTGKSGFKEFRFKLVRKPNQPPAYAIWKTVENLRNHDLIDSRQGFILEDLSFGAELLRVPLVNEVDEDDKTIPEDFDYIPSQCHSGMMTHEFHFDRQSLGCQNCRHQPCMHQNCTCVQRNGDLLPYHNNILVCRKPLIYECGGSCPCPDHCPTRLVQTGLKLHLEVFKTRNCGWGLRSWDPIRAGTFICEFAGLRKTKEEVEEDDDYLFDTSKIYQRFRWNYEPELLLEDSWEQVSEFINLPTQVLISAKEKGNVGRFMNHSCSPNVFWQPIEYENRGDVYLLIGLFAMKHIPPMTELTYDYGVSCVERSEEDEVLLYKGKKTCLCGSVKCRGSFT

SEQ ID NO: 184 - protein, 505 aa, Arabidopsis thaliana
RITEAERESGNQEIVDSILMRFDAVRRRLCQLNYRKDKILTASTNCMNLGVRTNMTRRIGPIPGVQVGDIFYYWCEMCLVGLHRNTAGGIDSLLAKESGVDGPAATSVVTSGKYDNETEDLETLIYSGHGGKPCDQVLQRGNRALEASVRRRNEVRVIRGELYNNEKVYIYDGLYLVSDCWQVTGKSGFKEYRFKLLRKPGQPPGYAIWKLVENLRNHELIDPRQGFILGDLSFGEEGLRVPLVNEVDEEDKTIPDDFDYIRSQCYSGMTNDVNVDSQSLVQSYIHQNCTCILKNCGQLPYHDNILVCRKPLIYECGGSCPTRMVETGLKLHLEVFKTSNCGWGLRSWDPIRAGTFICEFTGVSKTKEEVEEDDDYLFDTSRIYHSFRWNYEPELLCEDACEQVSEDANLPTQVLISAKEKGNVGRFMNHNCWPNVFWQPIEYDDNNGHIYVRIGLFAMKHIPPMTELTYDYGISCVEKTGEDEVIYKGKKICLCGSVKCRGSFG

We claim:

1. A method for producing a plant with reduced expression of one or more target nucleic acids, comprising:
   (a) providing a plant comprising a recombinant nucleic acid, wherein the recombinant nucleic acid encodes a recombinant polypeptide comprising a first amino acid sequence comprising a DNA-binding domain and a second amino acid sequence comprising a plant DMS3 polypeptide, wherein the second amino acid sequence comprises an amino acid sequence that is at least 95% identical to SEQ ID NO: 41; and
   (b) growing the plant under conditions whereby the recombinant polypeptide encoded by the recombinant nucleic acid is expressed and binds to the one or more target nucleic acids, thereby reducing expression of the one or more target nucleic acids to produce the plant with reduced expression of the one or more target nucleic acids.

2. The method of claim 1, wherein the DNA-binding domain comprises a zinc finger domain.

3. The method of claim 1, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

4. The method of claim 1, wherein the DNA-binding domain comprises a TAL effector targeting domain.

5. The method of claim 1, wherein the second amino acid sequence comprises an amino acid sequence that is 100% identical to SEQ ID NO: 41.

6. The method of claim 1, wherein the one or more target nucleic acids are endogenous nucleic acids.

7. The method of claim 1, wherein the one or more target nucleic acids are heterologous nucleic acids.

8. The method of claim 1, wherein expression of the one or more target nucleic acids is silenced.

9. A plant cell comprising a recombinant nucleic acid encoding a recombinant polypeptide comprising a first amino acid sequence comprising a DNA-binding domain and a second amino acid sequence comprising a plant DMS3 polypeptide, wherein the second amino acid sequence comprises an amino acid sequence that is at least 95% identical to SEQ ID NO: 41.

10. The plant cell of claim 9, wherein the second amino acid sequence comprises an amino acid sequence that is 100% identical to SEQ ID NO: 41.

11. The plant cell of claim 9, wherein the DNA-binding domain comprises a zinc finger domain.

12. The plant cell of claim 9, wherein the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain.

13. The plant cell of claim 9, wherein the DNA-binding domain comprises a TAL effector targeting domain.

14. The method of claim 1, further comprising:
   (c) crossing the plant with reduced expression of the one or more target nucleic acids to a second plant to produce one or more F1 plants with reduced expression of the one or more target nucleic acids.

15. The method of claim 14, further comprising:
   (d) selecting from the one or more F1 plants with reduced expression of the one or more target nucleic acids an F1 plant that (i) lacks the recombinant nucleic acid, and (ii) has reduced expression of the one or more target nucleic acids.

* * * * *